(12) United States Patent
Smith et al.

(10) Patent No.: US 8,372,952 B2
(45) Date of Patent: Feb. 12, 2013

(54) BINDING PROTEINS THAT BIND TO HUMAN FGFR1C, HUMAN β-KLOTHO AND BOTH HUMAN FGFR1C AND HUMAN β-KLOTHO

(75) Inventors: Richard Smith, Belmont, CA (US); Alice Bakker, Cupertino, CA (US); Amy N. Duguay, Saratoga, CA (US); Peng Li, San Francisco, CA (US); Yang Li, Mountain View, CA (US)

(73) Assignee: Amgen Inc., Thousand Oaks, CA (US)

( * ) Notice: Subject to any disclaimer, the term of this patent is extended or adjusted under 35 U.S.C. 154(b) by 0 days.

(21) Appl. No.: 12/958,209

(22) Filed: Dec. 1, 2010

(65) Prior Publication Data

US 2011/0150901 A1    Jun. 23, 2011

Related U.S. Application Data

(60) Provisional application No. 61/266,061, filed on Dec. 2, 2009, provisional application No. 61/381,364, filed on Sep. 9, 2010.

(51) Int. Cl.
*C07K 1/00* (2006.01)
*C07K 14/00* (2006.01)

(52) U.S. Cl. ........................................ 530/350; 530/363
(58) Field of Classification Search ........................ None
See application file for complete search history.

(56) References Cited

U.S. PATENT DOCUMENTS

| | | | |
|---|---|---|---|
| 3,773,919 A | 11/1973 | Boswell et al. |
| 4,179,337 A | 12/1979 | Davis et al. |
| 4,301,144 A | 11/1981 | Iwashita et al. |
| 4,376,110 A | 3/1983 | David et al. |
| 4,496,689 A | 1/1985 | Mitra |
| 4,640,835 A | 2/1987 | Shimizu et al. |
| 4,670,417 A | 6/1987 | Iwasaki et al. |
| 4,791,192 A | 12/1988 | Nakagawa et al. |
| 4,816,567 A | 3/1989 | Cabilly et al. |
| 4,892,538 A | 1/1990 | Aebischer et al. |
| 4,945,050 A | 7/1990 | Sanford et al. |
| 4,970,154 A | 11/1990 | Chang |
| 5,011,472 A | 4/1991 | Aebischer et al. |
| 5,106,627 A | 4/1992 | Aebischer et al. |
| 5,217,889 A | 6/1993 | Roninson et al. |
| 5,229,501 A | 7/1993 | Keifer et al. |
| 5,234,784 A | 8/1993 | Aslam et al. |
| 5,252,714 A | 10/1993 | Harris et al. |
| 5,272,071 A | 12/1993 | Chappel |
| 5,288,855 A | 2/1994 | Bergonzoni |
| 5,364,791 A | 11/1994 | Vegeto et al. |
| 5,489,743 A | 2/1996 | Robinson et al. |
| 5,545,807 A | 8/1996 | Surani et al. |
| 5,557,032 A | 9/1996 | Mak |
| 5,585,089 A | 12/1996 | Queen et al. |
| 5,589,362 A | 12/1996 | Bujard et al. |
| 5,593,875 A | 1/1997 | Wurm et al. |
| 5,635,399 A | 6/1997 | Kriegler et al. |
| 5,650,298 A | 7/1997 | Bujard et al. |
| 5,654,168 A | 8/1997 | Bujard et al. |
| 5,672,510 A | 9/1997 | Eglitis et al. |
| 5,676,954 A | 10/1997 | Brigham |
| 5,679,559 A | 10/1997 | Kim et al. |
| 5,693,762 A | 12/1997 | Queen et al. |
| 5,707,632 A | 1/1998 | Williams et al. |
| 5,811,234 A | 9/1998 | Roninson et al. |
| 6,133,426 A | 10/2000 | Gonzalez et al. |
| 6,150,098 A | 11/2000 | Zhang |
| 6,214,795 B1 | 4/2001 | Benjamin et al. |
| 6,255,454 B1 | 7/2001 | Keifer et al. |
| 6,344,546 B1 | 2/2002 | Dionne et al. |
| 6,350,593 B1 | 2/2002 | Williams et al. |
| 6,355,440 B1 | 3/2002 | Williams et al. |
| 6,384,191 B1 | 5/2002 | Williams et al. |
| 6,548,634 B1 | 4/2003 | Ballinger et al. |
| 6,579,850 B1 | 6/2003 | Nabeshima |
| 6,639,063 B1 | 10/2003 | Edwards |
| 6,656,728 B1 | 12/2003 | Kavanaugh |
| 6,716,626 B1 | 4/2004 | Itoh |
| 6,844,168 B1 | 1/2005 | Keifer et al. |
| 7,259,248 B2 | 8/2007 | Itoh |
| 7,381,804 B2 | 6/2008 | Osslund |
| 7,408,047 B1 | 8/2008 | Thomason |
| 7,459,540 B1 | 12/2008 | Thomason et al. |
| 7,491,697 B2 | 2/2009 | Beals |
| 7,498,416 B2 | 3/2009 | Yayon et al. |
| 7,531,304 B2 | 5/2009 | Bange |
| 7,645,857 B2 | 1/2010 | Zhou |
| 7,667,005 B2 | 2/2010 | Nabeshima et al. |
| 7,667,008 B2 | 2/2010 | Thomason et al. |
| 7,671,180 B2 | 3/2010 | Thomason et al. |
| 7,678,890 B2 | 3/2010 | Bosch et al. |
| 7,695,938 B2 | 4/2010 | Thomason et al. |
| 7,696,153 B2 | 4/2010 | Nissen et al. |
| 7,696,172 B2 | 4/2010 | Thomason et al. |
| 7,700,558 B2 | 4/2010 | Thomason et al. |
| 7,704,952 B2 | 4/2010 | Thomason et al. |
| 7,727,742 B2 | 6/2010 | Thomason et al. |
| 7,741,078 B2 | 6/2010 | Imamura et al. |
| 7,879,323 B2 | 2/2011 | Thomason et al. |
| 7,887,799 B2 | 2/2011 | Thomason et al. |
| 2001/0012628 A1 | 8/2001 | Agarwal et al. |

(Continued)

FOREIGN PATENT DOCUMENTS

EP      36676 A1    9/1981
EP      58481 A1    8/1982

(Continued)

OTHER PUBLICATIONS

Hu et al., (1998), "FGF-18, a novel member of the fibroblast growth factor family, stimulates hepatic and intestinal proliferation," Mol. Cell. Biol. 18(10) 6063-6074.

(Continued)

*Primary Examiner* — Shulamith H Shafer
(74) *Attorney, Agent, or Firm* — John A. Lamerdio; Scott N. Bernstein

(57) ABSTRACT

Binding proteins that specifically bind to β-Klotho or portions thereof, FGFR1c or portions thereof, or both FGFR1c and β-Klotho, and optionally other proteins as well are provided. Coding sequences, methods of treatment and pharmaceutical compositions are also provided.

31 Claims, 97 Drawing Sheets

U.S. PATENT DOCUMENTS

| | | | |
|---|---|---|---|
| 2002/0081663 A1 | 6/2002 | Conklin |
| 2002/0164713 A1 | 11/2002 | Itoh |
| 2003/0220246 A1 | 11/2003 | Conklin |
| 2004/0018499 A1 | 1/2004 | Lai |
| 2004/0063910 A1 | 4/2004 | Kavanaugh et al. |
| 2004/0185494 A1 | 9/2004 | Itoh |
| 2004/0259780 A1 | 12/2004 | Glasebrook |
| 2005/0037457 A1 | 2/2005 | Itoh |
| 2005/0176631 A1 | 8/2005 | Heuer |
| 2005/0187150 A1 | 8/2005 | Mohammadi et al. |
| 2006/0223114 A1 | 10/2006 | Stemmer |
| 2007/0036806 A1 | 2/2007 | Glaesner |
| 2007/0128619 A1 | 6/2007 | Ito |
| 2007/0142278 A1 | 6/2007 | Beals |
| 2007/0237768 A1 | 10/2007 | Glaesner |
| 2007/0238657 A1 | 10/2007 | Ito |
| 2007/0265200 A1 | 11/2007 | Glaesner |
| 2007/0274981 A1 | 11/2007 | Sun et al. |
| 2007/0293430 A1 | 12/2007 | Frye |
| 2007/0299007 A1 | 12/2007 | Frye |
| 2008/0071065 A1 | 3/2008 | Thomason |
| 2008/0071066 A1 | 3/2008 | Thomason |
| 2008/0103096 A1 | 5/2008 | Frye |
| 2008/0124344 A1 | 5/2008 | Combs et al. |
| 2008/0242607 A1 | 10/2008 | DeFrees et al. |
| 2008/0248959 A1 | 10/2008 | DeFrees et al. |
| 2008/0253992 A1 | 10/2008 | DeFrees et al. |
| 2008/0255040 A1 | 10/2008 | DeFrees et al. |
| 2008/0255045 A1 | 10/2008 | Cujec |
| 2008/0261236 A1 | 10/2008 | Kuro-o |
| 2008/0261875 A1 | 10/2008 | Etgen |
| 2008/0274958 A1 | 11/2008 | DeFrees et al. |
| 2009/0074776 A1 | 3/2009 | Itoh |
| 2009/0098131 A1 | 4/2009 | Clark et al. |
| 2009/0118190 A1 | 5/2009 | Beals et al. |
| 2009/0123462 A1 | 5/2009 | Bange |
| 2009/0192087 A1* | 7/2009 | Glass et al. ............ 514/12 |
| 2009/0202554 A1 | 8/2009 | Berezin et al. |
| 2009/0305986 A1 | 12/2009 | Belouski et al. |
| 2010/0047251 A1 | 2/2010 | Yayon et al. |
| 2010/0087627 A1 | 4/2010 | Marshall et al. |
| 2010/0158911 A1 | 6/2010 | Williams et al. |
| 2010/0158914 A1 | 6/2010 | Desnoyers et al |
| 2010/0184665 A1 | 7/2010 | Suzuki et al. |
| 2010/0226921 A1 | 9/2010 | Thomason et al. |
| 2010/0233169 A1 | 9/2010 | Thomason et al. |
| 2010/0285131 A1 | 11/2010 | Belouski |
| 2010/0310566 A1 | 12/2010 | Thomason et al. |
| 2011/0003302 A1 | 1/2011 | Thomason et al. |

FOREIGN PATENT DOCUMENTS

| | | |
|---|---|---|
| EP | 88046 A2 | 9/1983 |
| EP | 0133988 A2 | 3/1985 |
| EP | 143949 A1 | 6/1985 |
| EP | 154316 A2 | 9/1985 |
| EP | 401384 A1 | 12/1990 |
| EP | 505500 A1 | 9/1992 |
| EP | 0545343 A1 | 6/1993 |
| EP | 315456 B1 | 6/1994 |
| EP | 546073 B1 | 9/1997 |
| EP | 2060270 A2 | 10/2004 |
| EP | 2163626 A1 | 3/2010 |
| WO | 90/04036 | 4/1990 |
| WO | 91/09955 | 7/1991 |
| WO | 91/10425 | 7/1991 |
| WO | 91/10470 | 7/1991 |
| WO | 91/10741 | 7/1991 |
| WO | 93/15722 | 8/1993 |
| WO | 94/02602 | 2/1994 |
| WO | 94/20069 | 9/1994 |
| WO | 94/28122 | 12/1994 |
| WO | 95/05452 | 2/1995 |
| WO | 95/34670 | 12/1995 |
| WO | 96/11953 | 4/1996 |
| WO | 96/32478 | 10/1996 |
| WO | 96/33735 | 10/1996 |
| WO | 96/37609 | 11/1996 |
| WO | 96/40958 | 12/1996 |
| WO | 96/41865 | 12/1996 |
| WO | 97/31899 | 9/1997 |
| WO | 97/34631 | 9/1997 |
| WO | 99/10494 | 3/1999 |
| WO | 99/27100 | 6/1999 |
| WO | 00/18921 A2 | 4/2000 |
| WO | 00/024782 | 5/2000 |
| WO | 00/27885 A1 | 5/2000 |
| WO | 00/54813 | 9/2000 |
| WO | 01/18172 | 3/2001 |
| WO | 01/18209 | 3/2001 |
| WO | 01/32678 | 5/2001 |
| WO | 01/36640 | 5/2001 |
| WO | 01/38357 | 5/2001 |
| WO | 01/49849 | 10/2001 |
| WO | 01/72957 | 10/2001 |
| WO | 02/36732 | 5/2002 |
| WO | 03/011213 | 2/2003 |
| WO | 03/059270 | 7/2003 |
| WO | 2004/022095 A1 | 3/2004 |
| WO | 2004/044011 A2 | 5/2004 |
| WO | 2004/083381 A2 | 9/2004 |
| WO | 2004/100976 A1 | 11/2004 |
| WO | 2004/110472 | 12/2004 |
| WO | 2005/037235 A2 | 4/2005 |
| WO | 2005037235 A2 | 4/2005 |
| WO | 2005/061712 | 7/2005 |
| WO | 2005066211 A2 | 7/2005 |
| WO | 2005/072769 | 8/2005 |
| WO | 2005/091944 | 10/2005 |
| WO | 2005/113606 | 12/2005 |
| WO | 2006/028595 | 3/2006 |
| WO | 2006/028714 | 3/2006 |
| WO | 2006/065582 | 6/2006 |
| WO | 2006/078463 | 7/2006 |
| WO | 2006/095559 A1 | 9/2006 |
| WO | 2006/130527 A2 | 12/2006 |
| WO | 2007/055789 | 5/2007 |
| WO | 2007/100695 | 9/2007 |
| WO | 2008/011633 | 1/2008 |
| WO | 2008/121563 | 10/2008 |
| WO | 2008/149521 A1 | 11/2008 |
| WO | 2008/151258 | 12/2008 |
| WO | 2008/153705 | 12/2008 |
| WO | 2009/020802 | 2/2009 |
| WO | 09/149171 | 12/2009 |
| WO | 2010/006214 A1 | 1/2010 |
| WO | 10/129503 | 11/2010 |
| WO | 2006/050247 | 5/2011 |

OTHER PUBLICATIONS

Hull et al (1997), "Healing with basic fibroblast growth factor is associated with reduced indomethacin induced relapse in a human model of gastric ulceration," Gut 40: 204-10.

Inagaki, T. et al. (2005) "Fibroblast growth factor 15 functions as an enterohepatic signal to regulate bile acid homeostasis," Cell. Metab. 2:217-225.

Ishibashi et al., 2006, "Is arginine a protein-denaturant?" Protein Expr. Purif. 42: 1-6.

Itch and Ornitz (2004), "Evolution of the FGF and FGFR gene families." Trends in Genetics 20(11): 563-569.

Jakobovits et al., 1993, "Analysis of homozygous mutant chimeric mice: deletion of the immunoglobulin heavy-chain joining region blocks B-cell development and antibody production" Pros. Natl. Acad. Sci. U.S.A. 90: 2551-55.

Jakobovits et al., 1993. "Germ-line transmission and expression of a human-derived yeast artificial chromosome"Nature 362; 255-58.

Jones et al., 1986, "Replacing the complementarity-determining regions in a human antibody with those from a mouse" Nature 321: 522-25.

Kohler et al., "Continuous cultures of fused cells secreting antibody of predefined specificity," Nature 256: 495-97 (1975).

Kurosu, Hiroshi et al., "Tissue-specific Expression at Klotho and Fibroblast Growth Factor (FGF) Receptor Isoforms Determines Metabolic Activity of FGF19 and FGF21," J. Biol. Chem. 282:26687-26695 (2007).

Kurosu. Hiroshi & Koro-o. Makoto, (2008) "The klotho gene family and the endocrine fibroblast growth factors," Curr. Opin. Nephrol. Hypertens, 17:368-372.

Kurosu, Hiroshi & Kuro-o, Makoto, "The Klotho gene family as a regulator of endocrine fibroblast growth factors," Mol. Cell. Endocrinol. 299:72-78 (2009).

Kaufman et al. (1999), "Transgenic analysis of a 100-kb human beta-globin cluster-containing DNA fragment propagated as a bacterial artificial chromosome." Blood 94: 3178-3184.

Kennell (1971), "Principles and practices of nucleic acid hybridization," Progr. Nucl. Acid Res. Mol. Biol. 11: 259-301.

Kharitonenkov et al. (2005), "FGF-21 as a novel metabolic regulator." J. Clin. Invest. 115: 1627-1635.

Kharitonenkov et al. (2006), "The metabollic state of diabetic monkeys is regulated by FGF-21" Endocrinology DOI:10.1210/en.2006-1168.

Kharitonenkov et al. (2007), "The metabolic state of diabetic monkeys is regulated by FGF-21" Endocrinology 148:774-781.

Kharitonenkov et al. (2008), "Fibroblast Growth Factor-21 as a Therapeutic Agent for Metabolic Diseases" Biodrugs 22 1:37-44

Kornmann et al. (1998), "Role of fibroblast growth factors and their receptors in pancreatic cancer and chronic pancreatitis," Pancreas 17: 169-75.

Kozbor, 1984, "A human hybrid myeloma for production of human monoclonal antibodies" J. Immunol. 133: 3001.

Laemmli. 1970, "Cleavage of structural proteins during the assembly of the head of bacteriophage T4" Nature 227: 680-85.

Langer et al., 1981, "Biocompatibility of polymeric delivery systems for macromolecules" J. Biomed. Mater. Res. 15: 267-277.

Langer et al., 1982, "Controlled release of macromolecules" Chem. Tech. 12: 98-105.

Ledley (1996), "Pharmaceutical Approach to Somatic Gene Therapy." Pharm. Res. 13(11): 1595-1614.

Lewis et al. (1997), "Angiogenesis by gene therapy: a new horizon for myocardial revascularization?" Cardiovasc. Res. 135: 490-497.

Lin, Benjamin C., et al., "Liver-specific Activities of FGF19 Require Klotho beta," J. Bio. Chem. 282, 27277-27284 (2007).

Liu et al. (2007), "FGF18 is required for early chondrocyte proliferation, hypertrophy and vascular invasion of the growth plate." Dev. Biol. 302: 80-91.

Mahairas et al. (1999), "Sequence-tagged connectors: a sequence approach to mapping and scanning the human genome," PNAS 96(17): 9739-9744.

Mannall et al., 2007, "Factors affecting protein refolding yields in a fed-batch and batch-refolding system" Biotechnol. Bioeng. 97: 1523-34.

Marks et al., 1991, "By-passing immunization. Human antibodies from V-gene libraries displayed on phage" J. Mol. Biol. 222: 581-597.

Mikkelsen (1993), "Interpreting sequence motifs: a cautionary note," Trends Genet. 9(5), 15.

Mohammadi, et al. (2005). "Structural basis for fibroblast growth factor receptor activation" Cytokine & Growth Factors Reviews 16: 107-137.

Morrison et al., 1985, "Chimeric human antibody molecules: mouse antigen-binding domains with human constant region domains" Proc. Natl. Acad. Sci. U.S.A. 81:6851-55.

Moyers et al. (2007), "Molecular Determinants of FGF-21 Activity-Synergy and Cross-Talk with PPARγ Signalling" J. Cell. Phys. 210: 1-6

Nakamura et al. (1995), "The murine lymphotoxin-beta receptor cDNA: isolation by the signal sequence trap and chromosomal mapping," Genomics 30(2); 312-19.

Ngo et al, (1994), "Computational complexity, protein structure prediction, and the Levinthal paradox," in The Protein Folding Problem and Tertiary Structure Prediction, Merz & Le Grand ed., Birkhauser; Boston, pp. 491-495.

Nicholes, Katrina et al., "A mouse model of hepatocellular carcinoma: ectopic expression of fibroblast growth factor 19 in skeletal muscle of transgenic mice," Am. J. Pathol. 160:2295-2307 (2002).

Nishimura et al. (2000), "Identification of a novel FGF, FGF-21, preferentially expressed in the liver(I)," Biochim Biophys Acta 21:203-6.

Niyogi (1969), "The influence of chain length and base composition on the specific association of oligoribonucleotides with denatured deoxyribonucleic acid," J. Biol. Chem. 244(6): 1576-81.

Ogawa, Y., et al. (2005) "Klotho is required for metabolic activity of fibroblast growth factor 21," Proc. Natl. Acad. Sci. USA 104:7432-7437.

Parthiban et al, (2007), "Computational modelling of protein mutant stability: analysis and optimization of statistical potentials and structural features reveal insights into prediction model development," BMC Struct. Biol. 7:54.

Parthiban et al., 2006, "MSH2 is essential for the preservation of genome integrity and prevents homeologous recombination in the moss Physcomitrella patens" Nucleic Adds Res. 34: 232-42.

Peus and Pittelkow (1996), "Growth factors in hair organ development and the hair growth cycle," Dermatol. Clin. 14:559-72.

Phillips (2001), "The chattende of gene therapy and DNA delivery." J. Pharm, Pharmacology 53: 1169-1174.

Plotnikov et al. (1999), "Structural Basis for FGF Receptor Dimerization and Activation" Cell 98: 641-650.

Plotnikov et al. (2000) "Crystal Structures of Two FGF-FGFR Complexes Reveal the Determinants of Ligand-Receptor Specificity," Cell 101: 413-24.

[The] ADHR consortium (2000), "Autosomal dominant hypophosphataemic rickets is associated with mutalions in FGF23," Nature Genetics 26: 345-348.

Arner et al. (2008) "FGF21 attenuates lipolysis in human adipocytes—A possible link to improved insulin sensitivity" FEBS Letters 582: 1725-1730.

Artuc et al. (1999), "Mast cells and their mediators in cutaneous wound healing—active participants or innocent bystanders?" Exp. Dermatol, 8: 1-16.

Ausubel, et al., Current Protocols in Molecular Biology (Ausubel et al., eds., Green Publishers Inc. and Wiley and Sons 1994), title page.

Bayer et al., 1990, "Protein biotinylation" Meth Enz. 184: 136-63.

Beck and Podolsky (1999), "Growth factors in inflammatory bowel disease," Inflamm. Bowel Dis. 5: 44-60.

Bishop (1996), "Chromosomal insertion of foreign DNA." Reprod. Nutr. Dev. 36(6): 607-18.

Bork (2000), "Powers and pitfalls ins equence analysis: the 70% hurdle," Genome Res. 10(4): 398-400.

Bork (1996), "Go hunting in sequence databases but watch out for the traps," Trends Genet. 12(10): 425-27.

Branch (1998), "A good antisense molecule is hard to find," Trends Biochem Sci. 23(2): 45-50.

Brenner (1999), "Errors in genome annotation," Trends Genet. 15(4): 132-33.

Brodeur et al., Monoclonal Anitbody Production Techniques and Applications 51-63 (Marcel Dekker, Inc., 1987).

Bruggermann et al., (1993) "Designer mice: the production of human antibody repertoires in transgenic animals" Year in Immuno. 7: 33.

Capon et al., (1989), "Designing CD4 immunoadhesins for AIDS therapy" Nature 337: 525-31.

Cunha et al. (1996) "Keratinocyte growth factor as mediator of mesenchymal-epithelial interactions in the development of androgen target organs." Semin Cell Dev Biol 7: 203-210.

Dailey et al. (2005), "Mechanism underlying differential responses to FGF signaling," Cytokine & Growth Factor Reviews 16: 233-247.

Database Uniprot Q9DDN0, Accession No. 09DDN0, "Fibroblast growth factor 19," XP002596987 (2001).

Database Uniprot Q76B59, Accession No. Q76B59, "Fibroblast growth factor 19," XP002596988 (2004).

Database Uniprot B7U4G3, Accession No. B7U4G3, "FGF19," XP002596989 (2009).

Database Uniprot B3DHS4, Accession No. B3DGS4, "FGF19 protein," XP002596990 (2008).

Debernardez Clark E., (1998), "Refolding of recombinant proteins" Curr. Opin. Biotechnol. 9: 157-63.

Doeerks et al. (1998), "Protein annotation: detective work for function prediction," Trends Genet. 14(6): 248-50.

Ebadi et al. (1997), "Neurotrophins and their receptors in nerve injury and repair," Neurochem. Int. 30: 347-74.

Econs and McEnery (1997) "Autosomal dominant hypophosphatemic rickets/osteomalacia: clinical characterization of a novel renal phosphate-wasting disorder," J Clin Endocrinol metab 82:674-681.

Ellison et al., (1982), "The nucleotide sequence of a human immunoglobulin Cγ1 gene" Nucleic Acids Res. 10: 4071-9).

Eppstein, et al., (1985) "Biological activity of liposome-encapsulated murine inerferon γ is mediated by a cell membrane receptor" Proc. Natl. Acad. Sci. U.S.A. 82:3686-92.

Eswarakumar, et al. (2005) "Cellular signaling by fibroblast growth factor receptors" Cytokine & Growth Factor Reviews 16: 139-149.

Faham, S. et al., (1998) "Diversity does make a difference: fibroblast growth factor-heparin interactions," Curr. Opin. Struct. Biol. 8(5): 578-586.

Fausto, N., "Mouse liver tumorigenesis: models, mechanisms, and relevance to human disease." Seminars in Liver Disease 19: 243-252 (1999).

Francis et al. (1992), "Protein modification and fusion proteins," Focus on Growth Factors 3:4-10.

Freiberg & Zhu, (2004) "Polymer microspheres for controlled drug release" Int. J. Pharm. 282:1-18.

Fu, Ling, et al. (2004) "Fibroblast growth factor 19 increases metabolic rate and reverses dietary and leptin-deficient diabetes," Endocroinology 145:2594-2603.

Fukumoto, Seji, and Yamashita, T. (2007) "FGF23 is a hormone-regulating phosphate metabolism-Unique Biological characteristics of FGF21," Bone 40:1190-1195.

Fukumoto, Seji, (2008) "Actions and mode of actions of FGF19 subfamily members," Endocr. J. 55:23-31.

Galzie Z. et al. (1997), "Fibroblast Growth Factors and their Receptors", Biochemistry and Cell Biology 75(6): 669-685.

GenBank Acc. No. AB006136, Aug. 27, 1997.

GenBank Acc. No. AQ175436, Sep. 21, 1998, accessed Nov. 18, 2005.

GenBank Acc. No. AV050323, Jun. 16, 1999, accessed Nov. 18, 2005.

GenBank Acc. No. BAA99415, Aug. 3, 2000.

GenBank Acc. No.BAA99416, Jul. 11, 2000.

GenBank Acc. No. NP_061986. Apr. 6, 2003.

GenBank Acc. No. Q9NSA1, Oct. 1, 2000.

Ghielli et al. (1998), "Regeneration processes in the kidney after acute injury: role of infiltrating cells." Exp. Nephrol. 6: 502-507.

Goetz et al., "BBA—Molecular and Cell Biology of Lipids." Mol. Cell. Biol. 27:3417-28 (2007).

Goldfarb (1996), "Functions of fibroblast growth in vertebrate development," Cytokine Growth Factor Rev. 7 (4): 311-325.

Harmer, Nicholas J., et al., "The crystal structure of fibroblast growth factor (FGF) 19 reveals novel features of the FGF family and offers a structural basis for its unusual receptor affinity," Biochem 43(3): 629-640 (2004).

Ho, Han Kiat, et al., "Fibroblast growth factor receptor 4 regulates proliferation, anti-apoptosis and alpha-fetoprotein secretion during hepatocellular carcinoma progression and represents a potential target for therapeutic intervention," J. Hepatol. 50:118-127 (2009).

Hoogenboom et al., 1991, "By-passing immunisation, Human antibodies from synthetic repertoires of germline VH gene segments rearranged in vitro"J. Mol. Biol. 227: 381.

Hoppenreijs et al. (1996), "Corneal endothelium and growth factors." Surv. Ophthalmol. 41: 155-64.

Hsu et al. (1999), "Heparin is Essential for a Single Keratinoctye Growth Factor Molecule To Bind and Form a Complex with Two Molecules of the Extracellular Domain of Its Receptor," Biochemistry 38: 2523-34.

Podolsky (1997), "Healing the epithelium: solving the problem from two sides." J. Gastroenterol. 32: 122-6.

Polejaeva et al. (2000), "New advances in somatic cell nuclear transfer: application in transgenesis," Theriogenology 53(1): 117-26.

Ratajczak (1997), "Fibroblast growth factors and early hemopoietic cell development," Leuk. Lymphoma 27: 221-9.

Remington's Pharmaceutical Sciences (18th Ed., A.R. Gennaro, ed., Mack Publishing Company 1990), Table of Contents.

Riechmann et al., 1998, "Reshaping human antibodies for therapy" Nature 332: 323-27.

Rudolph et al., 1997, "Folding proteins," Protein Function: A Practical Approach (Creighton, ed., New York, IRL Press) 57-99.

Rulicke et al. (2000), "Germ line transformation of mammals by pronuclear microinjection," Exp. Physiol. 85(6): 589-601.

Sambrook, et al, Molecular Cloning: A Laboratory Manual (Cold Spring Harbor Laboratory Press, 1989), Table of Contents.

Schlessinger, J. et al., "Crystal Structure of a Ternary FGF-FGFR-Heparin Complex Reveals a Dual Role for Heparin in FGFR Binding and Dimerization," Mol. Cell 6:743-50 (2000).

Sidman et al., 1983, "Controlled release of macromolecules and pharmaceuticals from synthetic polypeptides based on glutamic acid" Biopolymers 22: 547-56.

Skolnick et al, (2000), "From genes to protein structure and function: novel applications of computational approaches in the genomic era," Trends Biotechnol. 18(1) 34-39.

Smallwood et al. (1996), "Fibroblast Growth Factor (FGF) homologous factors: new members of the FGF family implicated in nervous system development", PNAS 93: 9850-9857.

Smith et al. (1997), "The challenges of genome sequence annotation or 'the devil is in the details,'" Nat. Biotechnol. 15(12): 1222-23.

Tomlinson, E. et al. (2002) "Transgenic mice expressing human fibroblast growth factor-19 display increased metabolic rate and decreased adiposity," Endocriniology 143:17419-1747.

Trouiller, et al, (2006), "MSH2 is essential for the preservation of genome integrity and prevents homeologous recombination in the moss Physcomitrella patens" Nucleic Acids Research vol. 34, (1): 232-242.

Verhoeyen et al., 1988, "Reshaping human antibodies: grafting an antilysozyme activity" Science 239: 1534-36.

Verma et al. (1997), "Gene therapy—promises,problems and prospects." Nature 389: 239-242.

Wang et al. (1997), "Rapid analysis of gene expression (RAGE) facilitates universal expression profiling." Nuc. Acids Res. 27: 4609-4618.

Webster (1997), "Growth factors and myelin regeneration in multiple sclerosis," Mult. Scler. 3:113-20.

Wente et al. (2006), "Fibroblast Growth Factor-21 Improves Pancreatic B-Cell Function and Survival by Activation of Extracellular Signal-Regulated Kinase 1/2 and Akt Signaling Pathways" Diabetes 55: 2470-2478.

Wischke & Schwendeman, 2008, "Principles of encapsulating hydrophobic drugs in PLA/PLGA microparticles" Int. J. Pharm. 364: 298-327.

Wu, Xinle et al. (2008) "C-terminal Tail of FGF19 Determines its Specificity toward Klotho Co-receptors," J. Biol. Chem. 283(48):33304-9.

Xu et al., (2009) "Fibroblast Growth Factor 21 Reverses Hepatic Steatosis, Increases Energy Expenditure, and Improves Insulin Sensitivity in Diet-Induced Obese Mice" Diabetes 8(1):250-9.

Yamaoka and Itakura (1999), "Development of pancreatic islets (review)." Int. J. Mol. Med. 3:247-61.

Yie et al., 2009, "FGF21 N- and C-termini play different roles in receptor interaction and activation" FEBS Lett. 583:19-24.

Zola, Monoclonal Antibodies: A Manual of Techniques 147-158 (CRC Press, Inc., 1987).

Beenken. Andrew and Mohammad Mohammadi. Moosa (2009), "The FGF family: biology, pathophysiology and therapy," Nature Reviews 8:235-253.

R&D Systems, Catatog No. MAB3738, Lot No. XRU02 (2007), "Monclonal anti-human/mouse Klotho Beta antibody," XP-002624719.

Suzuki, Masashi et al. (2008) "Beta-klotho is required for librolast growth factor (FGF) 21 signaling through FGF receptor (FGFR) 1c and FGFR3c," Mol. Endocr. 22(4):1006-1014.

Li, Xiaofan, et al. (2009) "Inhibition of lipolysis may contribute to the acute regulation of plasma FFA and glucose by FGF21 in ob/ob mice," FEBS Letters 583: 323-03234.

Wu, Xinle et al. (2008) "C-terminal tail of FGF19 determines its specificity toward klotho co-receptors," J. Biol. Chem. 283 (46): 33304-33309.

Wu, Xinle et al, (2007) "Co-receptor requirements for librolast growth factor-19 signaling," J. Biol. Chem. 282 (40): 29069-29072.

Wu, Xinle et al. (2009) "Selective activation of FGFR4 by an FGF19 variant does not improve glucose metabolism in ob/ob," PNAS 106 (34): 14379-14384.

Wu, Xinle et al. (2010) "Separating mitogenic and metabolic activities of fibroblast growth factor 19 (FGF19)." PNAS 107 (32): 14158-14163.

Xu, Jing et al, (2009) "Acute glucose-lowering and insulin-sensitizing action of FGF21 in insulin-resistant mouse models-association with liver and adipose tissue effects," Am. J. Physiol. Endocrinol. Metab. 297: E1105-E1114.

Beenken, Andrew and Mohammadi, Moosa (2009), "The FGF family: biology, pathophysiology and therapy," Nature Reviews 8:235-253.

R&D Systems, Catalog No. MAB3738, Lot NO. XRU02 (2007), "Monoclonal anti-human/mouse Klotho Beta antibody," XP-002624719.

Suzuki, Masashi et al. (2008) "Beta-klotho is required for fibroblast growth factor (FGF) 21 signaling through FGF receptor (FGFR) 1c and FGFR3c," Mol. Endocr. 22(4):1006-1014.

Bork et al. (1998), "Predicting functions from protein sequences—where are the bottlenecks?" Nature Genetics 18 (4); 313-18.

Ogawa et al. (2007), "Beta-klotho is required for metabolic activity of fibroblast growth factor 21," PNAS 104(18) 7432-7437.

Wu, X. and Li, Y. (2011) Understanding the structure-function relationship between FGF19 and its motogenic and metabolic activities. In Endocrine FGFs and Klothos, edited by Makoto Kuro-o, Landes Bioscience and Springer Science Media.

Wu, X., et al. (2009) "Role of FGF19 induced FGFR4 activation in the regulation of glucose homeostasis," Aging 1:1023.

Wu et al. (2010), "FGF19 induced hepatocyte proliferation is mediated through FGFR4 activation." J. Biol. Chem. 285:5165.

* cited by examiner

LDL-receptor class A domain

```
LRP1_HUMAN    C.EPYQFRCKNNR.....CVPGRWQ.CDYDNDCGDNSDEES.....C
LRP1_HUMAN    C.LPSQFKCTNTNR....CIPGIFR.CNGQDNCGDGEDERD.....C
LDLR_HUMAN    C.SQDEFRCHDGK.....CISRQFV.CDSDRDCLDGSDEAS.....C
LRP2_HUMAN    C.SSSAFTCGHGE.....CIPAHWR.CDKRNDCVDGSDEHN.....C
LRP2_HUMAN    C.SSSEFQCASGR.....CIPQHWY.CDQETDCFDASDEPAS....C
CORI_HUMAN    CHSQGLVECRNGQ.....CIPSTFQ.CDGDEDCKDGSDEEN.....C
MAT_HUMAN     C.PAQTFRCSNGK.....CLSKSQQ.CNGKDDCGDGSDEAS.....C
CO8B_HUMAN    C...EGFVCAQTGR....CVNRRLL.CNGDNDCGDQSDEAN.....C
MAT_HUMAN     C.TKHTYRCLNGL.....CLSKGNPECDGKEDCSDGSDEKD....C
LDVR_HUMAN    CLGPGKFKCRSGE.....CIDISKV.CNQEQDCRDWSDEPLKE...C
APOER2_HUM    C.PAEKLSCGPTSHK...CVPASWR.CDGEKDCEGGADEAG....C
SORL_HUMAN    CTHFMDFVCKNRQQ....CLFHSMV.CDGIIQCRDGSDEDAAFAGC
ST7_HUMAN     C.AYNQFQCLSRFTKVYTCLPESLK.CDGNIDCLDLGDEID....C

*      *        * **
consensus     C.1234F6C12G4.....CI23456.CDG34DC1D3SDE78.....C
```

Figure 2

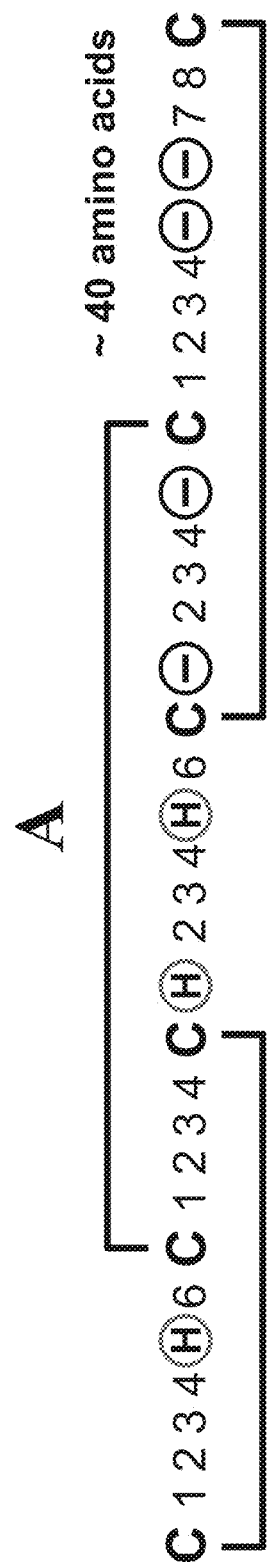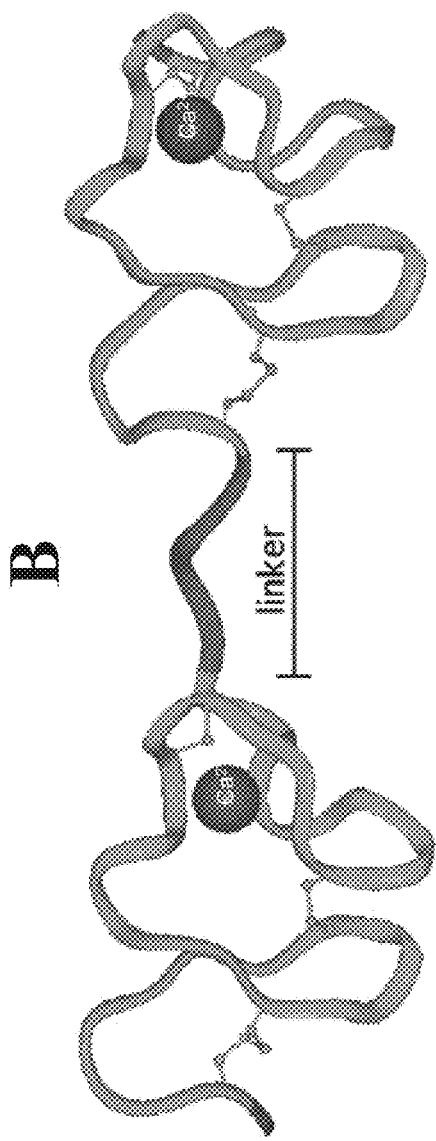
Figure 3

Ligands recognized by naturally-occurring LDL-receptor family

*proteases*
factor IXa
pro-uPA
t-PA
plasminogen
MMP-9

*inhibitors*
$\alpha_2$-macroglobulin
PAI-1
TFPI
pancreatic trypsin inhibitor

*complexes*
protease/
  $\alpha_1$-antitrypsin
  protein C inhibitor
  protease nexin-1
  antithrombin
  C1-inhibitor
thrombin/heparin cofactor II
cathepsin G/$\alpha_1$-antichymotrypsin

*vitamin-carrier complexes*
vitamin D-bp, vitamin D
retinol-bp, vitamin A
transcobalamin, vitamin B12

*proteins involved in lipoprotein metabolism*
apoB100
apoE
apoJ (clusterin)
apoH ($\beta_2$-glycoprotein I)
Lp(a)
hepatic lipase
lipoprotein lipase
IDL
VLDL
$\beta$-VLDL

*non-human*
pseudomonas exotoxin A
circumsporozoite protein
trichosanthin
ricin A
saporin

*antibiotics*
gentamicin
polymyxin B

*viruses*
HRV2 (Rhino)
HCV (Flavi)
BVDV (Flavi)

*miscellaneous*
albumin
transthyretin
$\beta$-Amyloid precursor protein
RAP
complement C3
lactoferrin
thyroglobulin
thrombospondin
saposin precursor
reelin
insulin
parathyroid hormone (PTH)
aprotinin
$\alpha$-amylase
C1q
$\alpha_1$-microglobulin
$\beta_2$-microglobulin
odorant-binding protein
epidermal growth factor
prolactin
lysozyme
connective tissue growth factor (CTGF)
cytochrome c
seminal vesicle secretory protein II
clara cell secretory protein (CCSP)
cubulin
factor VIII

| Binding Protein | Sequence | Binding ELISA EC50 (nM) |
|---|---|---|
| anti-FGFR1c M01 | CASGQFQCSNGNCVPQHWVCDGDNDCEDNSDEEDCGDSHILPFSTPGPSTSLQKASGALEHHHHHHH* | 6.8 |
| anti-FGFR1c M02 | CASGQFTCRSTNICLSLAWLCDGDDDCEDNSDESPAICSAPASEPPGSLSLQKASGALEHHHHHHH* | |
| anti-FGFR1c M03 | CGAGLFTCRSTKICISQAWVCDGVDDCEDNSDEKNCSAPASEPPGSLSLQKASGALEHHHHHHH* | 200 |
| anti-FGFR1c M04 | CRSRQFQCKGSSTCIPVQWVCDGDNDCGDSSDEAGCSAPASEPPGSLSLQKASGALEHHHHHHH* | ~1000 |
| anti-FGFR1c M05 | CGAGQFQCRSTNICISLKWVCDGVDDCEDNSDETSCSSAPASEPPGSLSLQKASGALEHHHHHHH* | |
| anti-FGFR1c M06 | CGAGQFQCRSTNICVSLAWRCDGEDDCEDNSDETSCATHTSLQKASGALEHHHHHHH* | |
| anti-FGFR1c M07 | CGAGQFTCNSTNICISPRWVCDGVNDCEDNSDEKNCSAPASEPPGSLSLQKASGALEHHHHHHH* | 109 |
| anti-FGFR1c M08 | CGAGQFTCRDTNICISRAWRCDGVDDCEDNSDEADCSQDPEFHKVSLQKASGALEHHHHHHH* | 525 |
| anti-FGFR1c M09 | CGAGQFTCRSTKICISQAWVCDGVDDCEDNSDEAGCGDSHILPFSTPGPSTSLQKASGALEHHHHHHH* | 88 |
| anti-FGFR1c M10 | CGAGQFTCRSTKICISQAWVCDGVDDCEDNSDEKNCSAPASELPGSLSLQKASGALEHHHHHHH* | 373 |
| anti-FGFR1c M11 | CGAGQFTCRSTKICISQAWVCDGVDDCEDNSDETSCSSAPASEPPGSLSLQKASGALEHHHHHHH* | 482 |
| anti-FGFR1c M12 | CGAGQFTCRSTNICLPLQWVCDGVDDCEDNSDEAGCGDSHILPFSTPGPSTSLQKASGALEHHHHHHH* | ~67 |
| anti-FGFR1c M13 | CGANQFTCHNTNICISLTWVCDGVDDCEDGDSESPDHCGRPGPGATSAPAASLQKASGALEHHHHHHH* | 23.4 |
| anti-FGFR1c M14 | CGANQFTCHNTNICISLTWVCDGVDDCEDNSDEAGCGDSHILPFSTPGPSTSLQKASGALEHHHHHHH* | 82 |
| anti-FGFR1c M15 | CGANQFTCHNTNICISQAWVCDGVDDCEDNDCEDNSDEKNCSAPASEPPGSLSLQKASGALEHHHHHHH* | |
| anti-FGFR1c M16 | CGARQFPCRGSRICISQPWVCDGNDCEDNSDEKNCSAPASEPPGSLSLQKASGALEHHHHHHH* | ~1500 |
| anti-FGFR1c M18 | CGPGQFTCQDTEICISQAWVCDGVDDCEGEDDCEDGSDEEGCGRPGPGATSAPAASLQKASGALEHHHHHHH* | 356 |
| anti-FGFR1c M19 | CGPIQFTCRNTNICLSVHWVCDGVDDCEGEDDCEDGSDEEGCGRPGPGATSAPAASLQKASGALEHHHHHHH* | 717 |
| anti-FGFR1c M20 | CGPNQFTCRSTNICLSQTWVCDGVDDCEDGSDETNCGRPGPGATSAPAASLQKASGALEHHHHHHH* | ~1000 |
| anti-FGFR1c M21 | CGPSQFTCRNTNICISLRWRCDGVDDCEDNSDEEGCGTTGPTSLQKASGALEHHHHHHH* | |
| anti-FGFR1c M23 | CGSNQFTCRSTNICISQAWVCDGVDDCEDDSDETGCSQDPEFHKVSLQKASGALEHHHHHHH* | 16.5 |
| anti-FGFR1c M24 | CGSSEFQCRNSRRCIPPAWVCDGNDCGDSSDEKSCGDSHILPFSTPGPSTSLQKASGALEHHHHHHH* | |
| anti-FGFR1c M25 | CGSSQFTCHNTNICLPQAWVCDGVDDCEDNSDEAGCGDSHILPFSTPGPSTSLQKASGALEHHHHHHH* | |
| anti-FGFR1c M26 | CGSSQFTCHNTNICLPRARVCDGVDDCEDNSDEAGCGDSHILPFSTPGPSTSLQKASGALEHHHHHHH* | |
| anti-FGFR1c M27 | CGSSQFTCHNTNICLPRAWVCDGVDDCEDNSDEAGCGDSHILPFSTPGPSTSLQKASGALEHHHHHHH* | 1256 |
| anti-FGFR1c M29 | CGSSQFTCHNTNICLPRAWVCDGVDDCEDNSDEKNCSAPASEPPGSLSLQKASGALEHHHHHHH* | 550 |
| anti-FGFR1c M30 | CGTGQFTCRSTKICISQAWVCDGVDDCEDNSDEKNCSAPASEPPGSLSLQKASGALEHHHHHHH* | ~2000 |
| anti-FGFR1c M31 | CLSDQFTCRSTNICLPLQWVCDGVDDCEDDDCEDNSDEEDCSAPASEPPGSLSLQKASGALEHHHHHHH* | 581 |
| anti-FGFR1c M32 | CQSNEFQCRSTGRCISVAWVCDGEDDCRDSSDEADCSQDPEFHKVSLQKASGALEHHHHHHH* | |
| anti-FGFR1c M33 | CRLNEFPCGSGSCISLHWVCDSVPDCRDDSDETDCPERTSLQKASGALEHHHHHHH* | |
| anti-FGFR1c M36 | CVPGQFQCNNGNCIPVTWLCDGDNDCGDSSDEAPAHCETSGPTSLQKASGALEHHHHHHH* | |
| anti-FGFR1c M38 | CVSGQFQCGNGNCIPQAWLCDGNDCGDSSDEKDCTTRTSLQKASGALEHHHHHHH* | ~2000 |
| anti-FGFR1c M39 | CVSGQFQCGNGNCIPRPWRCDGDNDCGDSSDETGCGDSHILPFSTPGPSTSLQKASGALEHHHHHHH* | |

Figure 10

| Avimer ID | Sequence | ELISA (hu) EC50 (nM) |
|---|---|---|
| anti-betaKlotho M01 | CLPDEFQCGSGRCIPQTWVCDGLNDCGDGSDESPAHCSQDPEFHKVSLQKASGALEHHHHHHH* | -- |
| anti-betaKlotho M02 | CAANEFRCSNGRCIPEPWLCDGLNDCGDGSDEPPHCAPPTSLQKASGALEHHHHHH* | -- |
| anti-betaKlotho M03 | CLPNQFRCGNGHCLSRTWVCDGVPDCEDNSDESLAHCSAPASEPPGSLSLQKASGALEHHHHHHHH* | -- |
| anti-betaKlotho M06 | CPPSQFTCGNGRCVSLQWVCDGLNDCGDGSDESPALCSAPASEPPGSLSLQKASGALEHHHHHHHH* | -- |
| anti-betaKlotho M08 | CPSNQFPCRSTGICIPLAWVCDGLNDCGDGSDESPATCKAPVPTSLQKASGALEHHHHHHHH* | -- |
| anti-betaKlotho M09 | CRANEFRCNSGRCLSQTWVCDGVDDCEDGSDESLAICGDSHILPFSTPGPSTSLQKASGALEHHHHHHH* | 606 |
| anti-betaKlotho M11 | CRPSEFRCRNSNRCIPRAWLCDGLNDCGDGSDEAPHCSAPASEPPGSLSLQKASGALEHHHHHHHH* | -- |
| anti-betaKlotho M12 | CRSSEFQCGNGHCLSRTWLCDGVNDCGDDSDEKNCAGAAPTSLQKASGALEHHHHHHH* | 63 |
| anti-betaKlotho M20 | CPSSQFQCKNGHCLSRTWLCDGVDDCQDGSDESPAICTASGHTSLQKASGALEHHHHHHH* | -- |
| anti-betaKlotho M21 | CQSNEFRCRSGRCIPQHWLCDGLNDCGDGSDESQQCSAPASEPPGSLSLQKASGALEHHHHHHH* | -- |
| anti-betaKlotho M23 | CRANQFTCNNGHCLSRTWLCDGVPDCEDNSDESLAICGDSHILPFSTPGPSTSLQKASGALEHHHHHHH* | 91 |
| anti-betaKlotho M25 | CRSSQFQCNNGHCLSPTWVCDGYDDCEDGSDEANCPTHTSLQKASGALEHHHHHHH* | 237 |
| anti-betaKlotho M28 | CASSEFQCRSTRTCVPLGWVCDGDNDCPDNSDETDCGDSHILPFSTPGPSTSLQKASGALEHHHHHHH* | 346 |
| anti-betaKlotho M31 | CPANQFRCNNGHCLSGTWLCDGVDDCGDNSDESSATCEPHTSLQKASGALEHHHHHHH* | -- |
| anti-betaKlotho M32-A | CQATAQFQCDNGHCLSANWRCDGVDDCGDNSDEEDCGDSHILPFSTPGPSTSLQKASGALEHHHHHHH* | 226 |
| anti-betaKlotho M33 | CRPSEFQCGNGSCLSATWLCDGVPDCGDGSDESPETCGDSHILPFSTPGPSTSLQKASGALEHHHHHHH* | 231 |
| anti-betaKlotho M36-A -B | CRSSEFQCNNGHCLSATWVCDGYDDCEDGSDEANCPTHTSLQKASGALEHHHHHHH* | 230 |
| anti-betaKlotho M37 | CSAFEFHCLSGECIHSSWRCDMDWDCKDQPDQLWCALETSLQKASGALEHHHHHHH* | 270 |
| anti-betaKlotho M38 | CSAFEFHCLSGECIHSSWRCDWDDDCKDWQDYVMCALEASLQKASGALEHHHHHHH* | 129 |
| anti-betaKlotho M39 | CSAFEFHCLSGECIHSSWRCDWDLDCKDHPDEVMCALEASLQKASGALEHHHHHHH* | 1180 |
| anti-betaKlotho M40 | CSAFEFHCLSGECIHSSWRCDWYWDCKDYWDPLVCELEASLQKASGALEHHHHHHH* | 253 |
| anti-betaKlotho M42-A | CQPDEFTCSSGRCIPQPWLCDGLNDCGDGSDEPPAHCSAPASEPPGSLSLQKASGALEHHHHHHH* | 162 |
| anti-betaKlotho M43 | CKSIAQFECSNGHCLSRTWLCDGVDDCGDNSDEALATCGDSHILPFSTPGPSTSLQKASGALEHHHHHHH* | 412 |
| anti-betaKlotho M44-A | CRPNEFQCGNGHCLSANWLCDGVDDCGDDSDETSCGDSHILPFSTPGPSTSLQKASGALEHHHHHHH* | 113 |
| anti-betaKlotho M45 | CRPNEFPCNNGRCLSQTWVCDGLNDCGDGSDESPELCSAPASEPPGSLSLQKASGALEHHHHHHH* | 51 |
| anti-betaKlotho M46 | CAPSQFQCHDNNICLLEGLLCDGEDDCADGSDEAPVCGDSHILPFSTPGPSTSLQKASGALEHHHHHHH* | 219 |
| anti-betaKlotho M47 | CPANQFRCNNGHCLSRTWVCDGYDDCEDGSDEANCPTHTSLQKASGALEHHHHHHH* | 404 |
| anti-betaKlotho M48-A | CQPDEFTCRSGRCIPQPWLCDGLNDCGDGSDEPPGHCTAPASEPPGSLTLQKASGALEHHHHHHH* | 300 |
| anti-betaKlotho M49-A | CRSNEFKCCGNGHCLSRTWLCDGVDDCGDDSDESPATCGDSHFVPFSSLGLNKALGNVYDHLHHHHHHH* | 596 |
| anti-betaKlotho M50 | CHSFNQFECRNGQCIPLHLVCDGVPDCGDNSDETDCGDSHILPFSTPGPSTSLQKASGALEHHHHHHH* | 68 |
| anti-betaKlotho M51 | CRANQFTCNNGHCLSRTWLCDGVPDCEDNSDESLAICGDSHILPFSTPGPSTSLQKASGALEHHHHHHH* | 121 |
| anti-betaKlotho M52 | CLSNQFQCNNGHCLSLTWRCDGYNDCGDSSDEENCAASEHTSLQKASGALEHHHHHHH* | 151 |
| anti-betaKlotho M53 | CLPGQFRCNSGHCLSQTWVCDGYNDCGDGSDEPLATCGDSHILPFSTPGPSTSLQKASGALEHHHHHHH* | 491 |
| anti-betaKlotho M54 | CQATAQFQCDNGHCLSANWRCDGVDDCGDNSDEEDCGDSHILPFSTPGPSTSLQKASGALEHHHHHHH* | 648 |
| anti-betaKlotho M55 | CPSSQFQCKNGHCLSRTWLCDGVDDCQDGSDESPATCGDSHILPFSTPGPSTSLQKASGALEHHHHHHH* | 2.4 |
| anti-betaKlotho M56 | CRSSEFKCKNGHCLSATWVCDGYVDCGDDSDEEDCATSGHTSLQKASGALEHHHHHHH* | |
| anti-betaKlotho M57 | CRSSQFPCQDSNICVLETLLCDGVDDCVDDSDEEDCGDSHILPFSTPGPSTSLQKASGALEHHHHHHH* | |

Figure 11

| Binding Protein ID | Sequence |
|---|---|
| bKlotho_LNR_M01 | CIAAKLCEALDGDGVCHKECDLEECDWDGGDCQRIFLTDPTSLQKASGALEHHHHHHH* |
| bKlotho_LNR_M02 | CPPHIEDHCERRDGDGVCQKPCDFYGCLWDGVNCDMDLVQELTSLQKASGALEHHHHHHHH* |
| bKlotho_LNR_M03 | CNPIIQHYCETYDGDGLCESACNFYGCAWDGFDCQVISDKDSTSLQKASGALEHHHHHHH* |
| bKlotho_LNR_M04 | CMAYNLCTALVGDGECDQECDTPTCNWDGGDCAVKSAPDSTSLQKASGALEHHHHHHH* |
| bKlotho_LNR_M05 | CMEAKSCQARDGDGDCGQGCNLAECIWDGMDCRPEWIRELTSLQKASGALEHHHHHHH* |
| bKlotho_LNR_M06 | CNPLYDDHCAAFFGDGGGCGPECSLAECLWDGGDCEEERDADVTSLQKASGALEHHHHHHH* |
| bKlotho_LNR_M07 | CNDVKCKRLDGDGHASNLVTNAECLWDGLDCPDVVISDLTSLQKASGALEHHHHHHH* |
| bKlotho_LNR_M08 | CIAAKLCERLDGDGSCQSECGNATCGWDGMDCDEKENDELTSLQKASGALEHHHHHHH* |
| bKlotho_LNR_M09 | CMAYLLCKKYYGDGICRSECDTATCSWDGFDCPVNEIEDLTSLQKASGALEHHHHHHH* |
| bKlotho_LNR_M10 | CPPHIEDHCERRDGDGVCQKPCDFYGCLWDGVDCDMDLVEELTSLQKASGALEHHHHHHH* |
| bKlotho_LNR_M11 | CMAYNLCQALVGDGSCNSECDTETCGWDGMDCATVEGAEATSLQKASGALEHHHHHHH* |
| bKlotho_LNR_M12 | CREYSMCTRFDGDGICHEQCGYPRCLWDGLDCANNFDHEVTSLQKASGALEHHHHHHH* |
| bKlotho_LNR_M13 | CNPLYDPHCRSYFGDGDCGPGCDLAACLWDGGDCPGVAAAELTSLQKASGALEHHHHHHH* |
| bKlotho_LNR_M14 | CHPLIREYCEKFFGDGGGCDSGCNNSRCDWDGDDCGLIQHGDVTSLQKASGALEHHHHHHH* |
| bKlotho_LNR_M15 | CNPLYDDHCAAFFGDGGGCPECSLAECLWDGGDCEEERDADVTSLQKASGALEHHHHHHH* |
| bKlotho_LNR_M16 | CNPKYDAHCASYFGDGECDPACSLAECVWDGDDCDPNFLTDVTSLQKASGALEHHHHHHH* |
| bKlotho_LNR_M17 | CPPHIEDHCERRDGDGVCQKPCDFYCLWDGVDCDMDLVEELTSLQKASGALEHHHHHHH* |
| bKlotho_LNR_M18 | CNPPIGQYCTQLFGDGDCGPDCDLAECVWDGDDCDPVAVPDVTSLQKASGALEHHHHHHHH* |
| bKlotho_LNR_M19 | CNPVYDPYCAAFFGDGGCGPHCGLAECVWDGMDCDHKEVRELTSLQKASGALEHHHHHHHH* |
| bKlotho_LNR_M20 | CHPLIREYCTHYDGDECDKGCDSAKCKWDGDDCDMDVLAEVTSLQKASGALEHHHHHHH* |
| bKlotho_LNR_M21 | CHPLIREYCTHYDGDECDKGCDSAKCKWDGDDCDMDVLAEVTSLQKASGALEHHHHHHH* |

Figure 12

| Avimer ID | ELISA(EC50) nM (human) | Monomer input | Sequence |
|---|---|---|---|
| betaKlotho mut.M01 | 277 | anti-betaKlotho M01 | CLPDEFQCGSGRCIPLTWVCDGLNDCGDGSDESPAHCSQDPEFHKVSLQKASGALEHHHHHHH* |
| betaKlotho mut.M02 | 198 | anti-betaKlotho M01 | CLPDEFQCRSGRCIPQTWVCDGLNDCGDGSDESPAQCSQDPEFHKVSLQKASGALEHHHHHHH* |
| betaKlotho mut.M03 | 89 | anti-betaKlotho M01 | CLPHEFQCGSGRCIPQTWVCDGLNDCGDGSDEWPAQCSQDPEFHKVSLQKASGALEHHHHHHH* |
| betaKlotho mut.M04 | 361 | anti-betaKlotho M01 | CLPHEFQCRSGRCIPQAWGCDGLNDCGDGSDESPAQCSQDPEFHKVSLQKASGALEHHHHHHH* |
| betaKlotho mut.M05 | 140 | anti-betaKlotho M01 | CLSDEFQCRSGRCIPQRWVCDGLNDCGDGSDEWPAQCSQDPEFHKVSLQKASGALEHHHHHHH* |
| betaKlotho mut.M06 | 133 | anti-betaKlotho M01 | CMPDEFQCRSGRCIPRSWVCDGLNDCGDGSDESPSHCSQDPEFHKVSLQKASGALEHHHHHHH* |
| betaKlotho mut.M07 | 135 | anti-betaKlotho M01 | CMTDEFRCRSGRCIPQTWVCDGLNDCGDGSDEWPAQCSQDPEFHKVSLQKASGALEHHHHHHH* |
| betaKlotho mut.M08 | 357 | anti-betaKlotho M01 | CPPDEFQCRSGWCIPQKWVCDGLNDCGDGSDESPALCSQDPEFHKVSLQKASGALEHHHHHHH* |
| betaKlotho mut.M09 | 248 | anti-betaKlotho M25 | CLPSQFQCNNGHCLSRTWVCDGYDDCGDWSDESNCPTHTSLQKASGALEHHHHHHH* |
| betaKlotho mut.M10 | 346 | anti-betaKlotho M25 | CLSGSFQCNGHCSNGHCLSRTWVCDGYVDCEDGSDEAKCPTHTSLQKASGALEHHHHHHH* |
| betaKlotho mut.M11 | 172 | anti-betaKlotho M25 | CLSSSFQCNNGHCLSRTWVCDGYYDCEDGSDEVNCPTHTSLQKASGALEHHHHHHH* |
| betaKlotho mut.M12 | 131 | anti-betaKlotho M25 | CRSGQFQCNNGHCLSATWVCDGYDDCDDGSDEANCPTHTSLQKASGALEHHHHHHH* |
| betaKlotho mut.M13 | 37 | anti-betaKlotho M25 | CRSGQFQCNNGHCLSQTWVCDGYDDCDDGSDEANCPTHTSLQKASGALEHHHHHHH* |
| betaKlotho mut.M14 | 49 | anti-betaKlotho M25 | CRSGQFQCNNGHCLSRTWVCDGYDDCDDGSDEANCPTHTSLQKASGALEHHHHHHH* |
| betaKlotho mut.M15 | 220 | anti-betaKlotho M25 | CRSGQFQCNNGHCLSSTWVCDGFDDCEDGSDEANCPTHTSLQKASGALEHHHHHHH* |
| betaKlotho mut.M16 | 29 | anti-betaKlotho M25 | CRSSEFQCNNGHCLSATWVCDGYDDCGDGSDESNCPTHTSLQKASGALEHHHHHHH* |
| betaKlotho mut.M17 | 25 | anti-betaKlotho M25 | CRSSEFQCNTGHCLSRTWVCDGYDDCGDGSDEANCPTHTSLQKASGALEHHHHHHH* |
| betaKlotho mut.M18 | 287 | anti-betaKlotho M25 | CRTSHFHCNNGHRLSRTWVCDGYEDCEDGSDEANCPTHTSLQKASGALEHHHHHHH* |
| betaKlotho mut.M19 | 36 | anti-betaKlotho M25 | CWSSAFQCNNGHCLSPSWVCDGYDDCDCDGSDEANCPTHTSLQKASGALEHHHHHHH* |
| betaKlotho mut.M20 | 136 | anti-betaKlotho M25 | CRSGQFQCNNGHCLSATWVCDGYDDCGDGSDEANCPTHTSLQKASGALEHHHHHHH* |
| betaKlotho mut.M21 | 272 | anti-betaKlotho M42 | CEPEEFRCRSGRCIPQTWLCDGLNDCGDGSDEPPAHCSAPASEPPGSLSLQKASGALEHHHHHHH* |
| betaKlotho mut.M22 | 184 | anti-betaKlotho M42 | CQPDEFTCRSGRCIPQSWLCDGLNDCGDGSDEPPAHCSAPASEPPGSLSLQKASGALEHHHHHHH* |
| betaKlotho mut.M23 | 126 | anti-betaKlotho M42 | CQPDEFTCSSGRCIPQIWLCDGLNDCGDGSDERPEHCSAPASEPPGSLSLQKASGALEHHHHHHH* |
| betaKlotho mut.M24 | 165 | anti-betaKlotho M42 | CQSDEFMCSSGRCIPVHWLCDGLNDCGDGSDERPAQCSAPASEPPGSLSLQKASGALEHHHHHHH* |
| betaKlotho mut.M25 | 23 | anti-betaKlotho M50 | CHSFNQFECRNGQCIPLYLVCDGVPDCADNSDETDCGDSYLPFSTPGPSTSLQKASGALEHHHHHHH* |
| betaKlotho mut.M26 | 43 | anti-betaKlotho M50 | CHTFNKFECRNGQCIPLYLVCDGVPDCGDNSDETACGDSHILPFSTPGPSTSLQKASGALEHHHHHHH* |
| betaKlotho mut.M27 | 272 | anti-betaKlotho M50 | CNSFNQFECRNRQCIPLYLVCDGVPDCGDNSDETYCGDSHILPFSTPGPSTSLQKASGALEHHHHHHH* |
| betaKlotho mut.M28 | 214 | anti-betaKlotho M50 | CPWFHHFKCRNGQRIPLHLVCDGVPDCGDDSDETDCGDSHILPFSTPGPSTSLQKASGALEHHHHHHH* |

Figure 13

| Binding Protein ID | Sequence | hu EC50(nM) |
|---|---|---|
| betaKlotho WD11 | CPPDQFRCRSGRCIPQHWLCDGLNDCGDGSDEANCEKRTCLPDEFQCGSGRCIPQTWVCDGLNDCGDGSDESPATCKAPVPTSLQKASGALEHHHHHH* | 131 |
| betaKlotho WD12 | CAPDQFRCSSGQCIPETWLCDGDDCVDSSDEAGCASTVPTCLPDEFQCGSGRCIPQTWVCDGLNDCGDGSDESPAHCSQDPEFHKVSLQKASGALEHHHHHH* | 47 |
| betaKlotho WD13 | CGPDQFRCRCNSGRCLPLDWRCDGVDDCEDGSDEAPDLCKTPARTCLPDEFQCGSGRCIPQTWVCDGLNDCGDGSDESPAHCSQDPEFHKVSLQKASGALEHHHHHH* | 10 |
| betaKlotho WD14 | CGPDQFRCKSGNCLPLNWVCDGVDDCGDSSDEEGCATPTCLPDEFQCGSGRCIPQTWVCDGLNDCGDGSDESPAHCSQDPEFHKVSLQKASGALEHHHHHH* | 10 |
| betaKlotho WD15 | CLPDEFRCQGSGRCIPQTWVCDGLNDCGDGSDESPAHCSQDPEFHKVCPSNQFPCRSTGICIPLAWVCDGLNDCGDGSDESPATCKAPVPTSLQKASGALEHHHHHH* | 36 |
| betaKlotho WD16 | CLPDEFRCGSGRCIPQTWVCDGLNDCGDGSDETGCRRPGFTCLPDEFQCGSGRCIPQTWVCDGLNDCGDGSDESQQCSAPASEPPGSLSLQKASGALEHHHHHH* | 172 |
| BK_R1c_D06 | CAPDQFRCSSGQCIPETWLCDGDDCVDSSDEAGCASTVPTCLPDEFQCGSGRCIPQTWVCDGLNDCGDGSDESPAHCSQDPEFHKVSLQKASGALEHHHHHH* | 30.66 |
| BK_R1c_D12 | CGPDQFKCNSGSCIPLTWVCDGDNDCGDGSDDSDETDCTKRTCLPDEFQCGSGRCIPQTWVCDGLNDCGDGSDESPAHCSQDPEFHKVSLQKASGALEHHHHHH* | 2.21 |
| betaKlotho WD01 | CLPDEFQCGSGRCIPQHWLCDGLNDCGDGSDEPPAHCSAPASEPPGSLCRAGEFRCSNGRCVPLTWLCDGEDDCQDNSDEKNCAQPTSLQKASGALEHHHHHH* | 0.05 |
|

| Binding Protein ID | Sequence | hu EC50(nM) |
|---|---|---|
| betaKlotho WD27 | CGPDQFRCSSGKCIPQHWLCDGLNDCGDGSDESPATCQRHTCQSNEFRCRSGRCIPQHWLCDGLNDCGDGSDESQQCSAPASEPPGSLSLQKASGALEHHHHHH* | 137 |
| betaKlotho WD28 | CGANEFQCRSTGICVPVEWVCDGDGNDCGDGSDEPPVCGDSHILPFSTPGPSTCQPDEFTCSSGRCIPQPWLCDGLNDCGDGSDEPPAHCSAPASEPPGSLSLQKASGALEHHHHHHH* | 3.1 |
| betaKlotho WD29 | CGADQFRCGNGSCVPRAWRCDGVDDCGDGSDEAPEICETPTCQSNEFRCRSGRCIPQHWLCDGLNDCGDGSDESQQCSAPASEPPGSLSLQKASGALEHHHHHHH* | 0.15 |
| betaKlotho WD25 | CGPDEFRCNNGQCIPLPWRCDGVDDCGDNSDEPLEICQAPTCQSNEFRCRSGRCIPQHWLCDGLNDCGDGSDEPPAHCSAPASEPPGSLSLQKASGALEHHHHHHH* | 5.4 |
| BK_R1c_D08 | CASGEFTCNNGQCVPLAWRCDGVNDCQDGSDEKGCTPHTCQSNEFRCRSGRCIPHTCQSAVHTCQSNEFRCRSGRCIPQHWLCDGLNDCGDGSDESPAHCSQDPEFHKVSLQKASGALEHHHHHH* | 3.44 |
| BK_R1c_D18 | CPPDEFQCRGTKKCLPLAWVCDGNDCEDDSDEESCASAVHTCQSNEFRCRSGRCIPQHWLCDGLNDCGDGSDESQQCSAPASEPPGSLSLQKASGALEHHHHHHH* | 21.48 |
| betaKlotho WD24 | CQSNEFRCRSGRCIPQHWLCDGLNDCGDGSDESQQCSAPASEPPGSLCPPGQFRCRNGSCIPATWLCDGDNDCGDNSDEEDCTPPTSLQKASGALEHHHHHHH* | 0.68 |
| betaKlotho WD26 | CQSNEFRCRSGRCIPQHWLCDGLNDCGDGSDEPPAHCSAPASEPPGSLCAANQFTCGNGNCIPLHWVCDGDNDCQDGSDETNCEEHTSLQKASGALEHHHHHHH* | 3.3 |
| betaKlotho WD31 | CAPDQFRCKSGNCIPLAWRCDGEDDCRDGSDEESCSAPASEPPGSLCQPDEFTCSSGRCIPQPWLCDGLNDCGDGSDEPPAHCSAPASEPPGSLSLQKASGALEHHHHHHH* | 2 |
| betaKlotho WD32 | CQAGQFQCESGNCVPPNWLCDGENDCADSSDEANCRRAAHTCQPDEFTCSSGRCIPLAWVCDGLNDCGDGSDESPATCKAPVPTSLQRASGALEHHHHHH* | 31.6 |
| BK_R1c_D21 | CPSGQFQCNNGHCLSATWLCDGVDDCGDGSDEKGCGDSHILPFSTPGPSTCQPDEFTCSSGRCIPQPWLCDGLNDCGDGSDEPPAHCSAPASEPPGSLSLQKASGALEHHHHHHH* | 39.16 |
| BK_R1c_D24 | CRPDEFPCRSTGRCVPRRWVCDGVDDCGDNSDESLAHCQTPTCQPDEFTCSSGRCIPQPWLCDGLNDCGDGSDEPPAHCSAPASEPPGSLSLQKASGALEHHHHHH* | 8.52 |
| betaKlotho WD30 | CQPDEFQCGSGRCIPQTWVCDGLNDCGDGSDEPPAHCSQDPEFHKVCRPGEFQCGSGHCIPGPWVCDGPDCQDGSDEANCEQRTSLQKASGALEHHHHHH* | 21 |
| BK_R1c_D22 | CQPDEFTCSSGRCIPQPWLCDGLNDCGDGSDEPPAHCSAPASEPPGSLCRPDEFRCKNGRCIPQTWVCDGEDDCQDSSDETDCESTVRTSLQKASGALEHHHHHHH* | 98.97 |
| BK_R1c_D23 | CQPDEFTCSSGRCIPQPWLCDGLNDCGDGSDEPPAHCSAPASEPPGSLCRPDEFRCRNGRCVPLTWRCDGEDDCQDGSDEEGCAPPTSLQKASGALEHHHHHHH* | 0.27 |
| betaKlotho WD35 | CAPGEFQCSNGNCLPPNWLCDGVDDCGDGSDESADCTEPTCHSFNQFECRNGQCIPLHLVCDGVPDCGDNSDETDCGDPHILPFSTPGPSTSLQKASGALEHHHHHHH* | 2 |
| betaKlotho WD36 | CAPDEFRCRNGNCIPLPWVCDGENDCRDDSDEEDCEAPGRTCHSFNQFECRNGQCIPLHLVCDGVPDCGDNSDETDCGDSHILPFSTPGPSTSLQKASGALEHHHHHHH* | 2.4 |
| betaKlotho WD37 | CLSQQFQCNNYETCIPRPWLCDGDDCVDGSDEEDCETRTCHSFNQFECRNGQCIPLHLVCDGVPDCGDNSDETDCGDSHILPFSTPGPSTSLQKASGALEHHHHHHH* | 7 |
| betaKlotho WD38 | CAAGEFQCSSGRCLPRPWVCDGNDCGDNSDETNCRASAHTCHSFNQFECRNGQCIPLHLVCDGVPDCGDNSDETDCGDSHILPFSTPGPSTSLQKASGALEHHHHHHH* | 2.6 |
| betaKlotho WD39 | CRSGEFRCKNGRCIPQHWVCDGENDCGDGSDETNCGROGPGATSAPAACHSFNQFECRNGQCIPLHLVCDGVPDCGDNSDETDCGDSHILPFSTPGPSTSLQKASGALEHHHHHHH* | 0.01 |
| BK_R1c_D05 | CAAGQFRCHNSDTCLPGAWVCDGNDCGDNSDEASCQKRTCHSFNQFECRNGQCIPLHLVCDGVPDCGDNSDETDCGDSHILPFSTPGPSTSLQKASGALEHHHHHHH* | 0.01 |
| BK_R1c_D07 | CAPNEFRCRSTGRCIPVNWVCDGDDCADNSDEAGCPEPTCHSFNRFECRNGQCIPLHLVCHSFNQFECRNGQCIPLHLVCDGVPDCGDNSDETDCGDSHILPFSTPGPSTSLQKASGALEHHHHHHH* | 0.35 |
| BK_R1c_D10 | CAGDQFQCGSGRCVPATWRCDGEDDCGDGSDEENCSQDPEFHKVCHSFNQFECRNGQCIPLHLVCDGVPDCGDNSDETDCGDSHILPFSTPGPSTSLQKASGALEHHHHHHH* | 167.70 |
| BK_R1c_D17 | CLPGQFTCGNGRCIPLPWVCDGVNDCEDNSDEESCEQHTCHSFNQFECRNGQCIPLHLVCDGVPDCGDNSDETDCGDSHILPFSTPGPSTSLQKASGALEHHHHHHH* | 0.07 |
| betaKlotho WD33 | CHSFNQFECRNGQCIPLHLVCDGVPDCGDNSDETDCGDSHILPFSTPGPSTCQSGEFRCQNTRTCLPLKLLODGVDDCLDDSDEKDCGTTGRTSLQKASGALEHHHHHH* | 66 |
| betaKlotho WD34 | CHSFNQFECRNGQCIPLHLVCDGVPDCGDNSDETDCGDSHILPFSTPGPSTCLPGQFRCKTGRCIPRAWVCDGVDDCEDDSDEADCGRPGPGATSAPAASLQKASGALEHHHHHHH* | 5 |

Figure 14, continued

| Avimer ID | A.A. Sequence |
|---|---|
| R1c_M03 | CGAGLFTCRSTKICISQAWVCDGVDDCEDNSDEKNCSAPASEPPGSLSLQKASGALEHHHHHHH* |
| R1c_M08 | CGAGQFTCRDTNICISRAWRCDGVDDCEDNSDEADCSQDPEFHKVSLQKASGALEHHHHHHH* |
| R1c_M15 | CGANQFTCHNTNICSQAWVCDGVDDCEDNSDEKNCSAPASEPPGSLSLQKASGALEHHHHHHH* |
| R1c_M23 | CGSNQFTCRSTNICSQAWVCDGVDDCEDDSDETGCSQDPEFHKVSLQKASGALEHHHHHHH* |
| R1c_M31 | CLSDQFTCRSTNICLPLQWVCDGDDDCEDNSDEEDCSAPASEPPGSLSLQKASGALEHHHHHHH* |
| R1c_M33 | CRLNEFPCGSGSCGISLHWVCDSVPDCRDDSDETDCPERTSLQKASGALEHHHHHHH* |
| BK_newM03 | CIAAKLCEALDGDGVCHKECDLEECDWDGGDCQRIFLTDPTSLQKASGALEHHHHHHH* |
| BK_mutM07 | CMTDEFRCRSGRCIPQTWVCDGLNDCGDGSDEWPAQCSQDPEFHKVSLQKASGALEHHHHHHH* |
| BK_mutM19 | CWSSAFQCNNGHCLSPSWVCDGYDDCGDGSDEANCPTHTSLQKASGALEHHHHHHH* |
| BK_RI_M02 | CWSGAFECKNGHCLSRTWVCDGFDDCGDGSDESAAHCSQDPEFHKVSLQKASGALEHHHHHHH* |
| BK_WD01 | CLPDEFQCGSGRCIPQHWLCDGLNDCGDGSDEPPAHCSAPASEPPGSLCRAGEFRCSNGRCVPLTWLCDGEDDCQDNSDEKNCAQPTSLQKASGALEHHHHHHH* |
| BK_WD02 | CLPDEFQCSSGRCIPQTWVCDGLNDCGDGSDEPPAHCSQDPEFHKVCPSSEFRCNNGRCIPLHWVCDGDDDCQDNSDETDCERSGRTSLQKASGALEHHHHHHH* |
| BK_WD31 | CLPDEFRCGNGNCISVAWRCDGVDDCEDGSDEEDCESPEHTCQSNEFRCRSGRCIPQHWLCDGLNDCGDGSDESPAHCSQDPEFHKVSLQKASGALEHHHHHHH* |
| BK_RI_D02 | CRASQFQCNNGHCLSPTWVCDGYDDCDDGSDEAICPTHTSLDYAPGLEASGGSCRSSQFQCNSGHCLSQTWVCDGYDDCQDASDESNCPTHTSLQKASGALEHHHHHHH* |
| BK_RI_D05 | CAAGQFRCHNSDTCLPGAWVCDGNDCGDNDCGDNSDEASCQKRTCHSFNQFECRNGQCIPLHLVCDGVPDCGDNSDETDCGDSHILPFSSTPGPSTSLQKASGALEHHHHHHH* |
| BK_RI_D06 | CAPDQFRCSSGQCIPETWLCDGDDDCVDSSDEAGCASTVPTCLPDEFQCGSGRCIPQTWVCDGLNDCGDGSDEPPAHCSQDPEFHKVSLQKASGALEHHHHHHH* |
| BK_RI_D07 | CAPNEFRCRSTGRCIPVNWVCDGDDDCADNSDEAGCPEPTCHSFNRFECRNGQCIPLHLVCDGVPDCGDNSDETDCGDSHILPFSTPGPSTSLQKASGALEHHHHHHH* |
| BK_RI_D09 | CASNQFRCGNGHCLSRTWLCDGVNDCEDGSDEADCSAPASEPPGSLCPPSQFTCGNGRCVSLGWVCDGLNDCGDGSDEPPALCSAPASEPPGSLSLQKASGALEHHHHHHH* |
| BK_WD25 | CGPDEFRCNNGQCIPLPWRCDGVDDCGDNSDEPLEICQAPTCQSNEFRCRSGRCIPQHWLCDGLNDCGDGSDEPPAHCSAPASEPPGSLSLQKASGALEHHHHHHH* |
| BK_RI_D25 | CRPNEFRCGNGHCLSQTWVCDGVDDCLDGSDEESCGRPGPGATSAPAACPSNQFPCRGTGICIPLAWVCDGLNDCGDGSDESPATCKAPVPTSLQKASGALEHHHHHHH* |

Figure 15

| Avimer ID | Target | Dimer/ Monomer? | ELISA huR1c EC50 (nM) | ELISA huR1b EC50 (nM) | ELISA huR4 EC50 (nM) | ELISA huBK EC50 (nM) | ELISA muBK EC50 (nM) | Alphascreen Inhibition ||||
|---|---|---|---|---|---|---|---|---|---|---|---|
| | | | | | | | | FGF21/BK+ R1c IC50 (nM) | FGF21/BK+R 4 IC50 (nM) | BK_R1c IC50 (nM) | BK_R4 IC50 (nM) |
| R1c_M03 | huFGFR1c | Monomer | 6.76 | 1.99 | no bind | no tested | no tested | 238.6 | no inhibit | no inhibit | no inhibit |
| R1c_M08 | huFGFR1c | Monomer | 109 | 17 | no bind | no tested | no tested | 3390 | no inhibit | no inhibit | no inhibit |
| R1c_M15 | huFGFR1c | Monomer | 81.97 | 18.6 | no bind | no tested | no tested | 434.5 | no inhibit | no inhibit | no inhibit |
| R1c_M23 | huFGFR1c | Monomer | 16.45 | 4.25 | ~300 | no tested | no tested | 240 | no inhibit | no inhibit | no inhibit |
| R1c_M31 | huFGFR1c | Monomer | ~300 | 112 | ~300 | no tested | no tested | 1000 | 5000 | partial? | no inhibit |
| R1c_M33 | huFGFR1c | Monomer | ~300 | no bind | ~300 | no tested | no tested | 500 | no inhibit | no inhibit | no inhibit |
| BK_newM03 | betaKlotho | Monomer | not tested | not tested | not tested | 0.8 | no bind | 16.22 | 9.76 | no inhibit | no inhibit |
| BK_mutM07 | betaKlotho | Monomer | not tested | not tested | not tested | 30.06 | 145 | no inhibit | not test | no inhibit | not test |
| BK_mutM19 | betaKlotho | Monomer | not tested | not tested | not tested | 142.5 | 26.94 | partial | not test | partial | not test |
| BK_RI_M02 | betaKlotho | Dimer | not tested | not tested | weak | 4.64 | 0.84 | 19.66 | 109.4/partial | 16.62 | 44.24/partial |
| BK_WD01 | betaKlotho | Dimer | no bind | not tested | 45.11 | <0.4 | weak | no inhibit | not test | no inhibit | not test |
| BK_WD02 | betaKlotho | Dimer | no bind | not tested | 1.16 | <0.4 | no bind | no inhibit | not test | no inhibit | not test |
| BK_WD31 | betaKlotho | Dimer | no bind | not tested | 20.92 | 1.9 | weak | 50/partial | not test | no inhibit | not test |
| BK_RI_D02 | betaKlotho | Dimer | no bind | not tested | weak | 1.01 | 0.62 | 1.41 | 207.1 | 0.96 | partial |
| BK_RI_D05 | betaKlotho | Dimer | no bind | not tested | 45.11 | <0.1 | weak | 5.13 | 1.12 | no inhibit | no inhibit |
| BK_RI_D06 | betaKlotho | Dimer | no bind | not tested | 1.16 | 30.66 | no bind | 74.71 | SPIKE | no inhibit | SPIKE |
| BK_RI_D07 | betaKlotho | Dimer | no bind | not tested | 20.92 | 0.35 | no bind | 11.91 | 3.68 | no inhibit | no inhibit |
| BK_RI_D09 | betaKlotho | Dimer | no bind | not tested | 300 | 24.46 | 88.93 | 12.7 | 194.9 | 35.38 | partial |
| BK_WD25 | betaKlotho | Dimer | no bind | not tested | 1.94 | 0.11 | 152 | 10.79 partial | no inhibit | partial | no inhibit |
| BK_RI_D25 | betaKlotho | Dimer | no bind | not tested | weak | 3.41 | 157.2 | 5.82 | 54.39/partial | 11.36 | 58.9/partial |

| Binding Protein ID | Construct | Sequence |
|---|---|---|
| αFGFR1c M15-αKlotho M01 | C114 | CGANQFTCHNTNICISQAWVCDGVDDCEDNSDEKNCSAPASEPPGSLCLPDEFQCGSGRCIPQTWVCDGLX DCGDGSDESPAHCSQDPEFHKVSLQKASGALEHHHHHH* |
| αFGFR1c M15-αKlotho M01 | C139 | CGANQFTCHNTNICISQAWVCDGVDDCEDNSDEKNCSAPASEPPGSLGGGGSCIPDEFQCGSSGRCIPQTWV CDGLNDCGDGSDESPAHCSQDPEFHKVSLQKASGALEHHHHHH* |
| αFGFR1c M15-αKlotho M01*** | C140 | CGANQFTCHNTNICISQAWVCDGVDDCEDNSDEKNCSAPASEPPGSLGGGGSGGGGSCLPDEFQCGSGRCI PQTWVCDGLNDCGDGSDESPAHCSQDPEFHKVSLQKASGALEHHHHHH* |
| αFGFR1c M15-αKlotho M01 | C122 | CGANQFTCHNTNICISQAWVCDGLNDCGDGSDESPAHCSQDPEFHKVSLQKASGALEHHHHHH* SGRCIPQTWVCDGLNDCGDGSDESPAHCSQDPEFHKVSLQKASGALEHHHHHH* |
| αβKlotho M01-αFGFR1c M15 | C130 | CLPDEFQCGSGRCIPQTWVCDGLNDCGDGSDESPAHCSQDPEFHKVCGANQFTCHNTNICISQAWVCDGVD DCEDNSDEKNCSAPASEPPGSLQKASGALEHHHHHH* |
| αβKlotho M01-αFGFR1c M15 | C131 | CLPDEFQCGSGRCIPQTWVCDGLNDCGDGSDESPAHCSQDPEFHKVSLGGGGSGGGGSCGANQFTCHNTNI CISQAWVCDGVDDCEDNSDEKNCSAPASEPPGSLQKASGALEHHHHHH* |
| αβKlotho M01-αFGFR1c M15 | C132 | CLPDEFQCGSGRCIPQTWVCDGLNDCGDGSDEKNCSAPASEPPGSLQKASGALEHHHHHH* HNTNICISQAWVCDGVDDCEDNSDEKNCSAPASEPPGSLGGGGSGGGGSCGANQFTC |

FIG. 22B

| Binding Protein ID | Construct | Sequence |
|---|---|---|
| αFGFR1c M15-αKlotho M42 | C2116 | CGANQFTCHNTNICISQAWVCDGVDDCEDNSDEKNCSAPASEPPGSLCQPDEFTCSSGRCIPQP WLCDGLNDCGDGSDEPPAHCSAPASEPPGSLSLQKASGALEHHHHHH* |
| αFGFR1c M15-αKlotho M42 | C2120 | CGANQFTCHNTNICISQAWVCDGVDDCEDNSDEKNCSAPASEPPGSLGGGSCQPDEFTCSSG RCIPQPWLCDGLNDCGDGSDEPPAHCSAPASEPPGSLSLQKASGALEHHHHHH* |
| αFGFR1c M15-αKlotho M42 | C2141 | CGANQFTCHNTNICISQAWVCDGVDDCEDNSDEKNCSAPASEPPGSLGGGSGGGGSCQPDE FTCSSGRCIPQPWLCDGLNDCGDGSDEPPAHCSAPASEPPGSLSLQKASGALEHHHHHH* |
| αFGFR1c M15-αKlotho M42 | C2142 | CGANQFTCHNTNICISQAWVCDGVDDCEDNSDEKNCSAPASEPPGSLGGGSGGGGSGGGGS CQPDEFTCSSGRCIPQPWLCDGLNDCGDGSDEPPAHCSAPASEPPGSLSLQKASGALEHHHH HH* |
| αKlotho M42-αFGFR1c M15 | C2133 | CQPDEFTCSSGRCIPQPWLCDG_NDCGDGSDEPPAHCSAPASEPPGSLCGANQFTCHNTNICIS QAWVCDGVDDCEDNSDEKNCSAPASEPPGSLSLQKASGALEHHHHHH* |
| αKlotho M42-αFGFR1c M15 | C2134 | CQPDEFTCSSGRCIPQPWLCDG_NDCGDGSDEPPAHCSAPASEPPGSLGGGSCGANQFTC HNTNICISQAWVCDGVDDCEDNSDEKNCSAPASEPPGSLSLQKASGALEHHHHHH* |
| αKlotho M42-αFGFR1c M15 | C2135 | CQPDEFTCSSGRCIPQPWLCDG_NDCGDGSDEPPAHCSAPASEPPGSLGGGSGGGGSCG ANQFTCHNTNICISQAWVCDGVDDCEDNSDEKNCSAPASEPPGSLSLQKASGALEHHHHHH* |
| αKlotho M42-αFGFR1c M15 | C2136 | CQPDEFTCSSGRCIPQPWLCDG_NDCGDGSDEPPAHCSAPASEPPGSLGGGSGGGGSGG GSFMCGANQFTCHNTNICISQAWVCDGVDDCEDNSDEKNCSAPASEPPGSLSLQKASGALEH HHHHHH* |

FIG. 22C

| Binding Protein ID | Construct | Sequence |
|---|---|---|
| αFGFR1c M15-αβKlotho M5) | C2117 | CGANQFTCHNTNICISQAWVCDGVPDCGDNSDEKNCSAPASEPPGSLCHSFNQFECRNGQCIPLHLVCDGVPDCGDNSDETDCGDSHILPFSTPGPSTSLQKASGALEHHHHHH* |
| αFGFR1c M15-αβKlotho M5) | C2121 | CGANQFTCHNTNICISQAWVCDGVPDCGDNSDEKNCSAPASEPPGSLGGGGSCHSFNQFECRNGQCIPLHLVCDGVPDCGDNSDETDCGDSHILPFSTPGPSTSLQKASGALEHHHHHH* |
| αFGFR1c M15-αβKlotho M5) | C2143 | CGANQFTCHNTNICISQAWVCDGVPDCGDNSDEKNCSAPASEPPGSLGGGGSGGGGSGGGGSCHSFNQFECRNGQCIPLHLVCDGVPDCGDNSDETDCGDSHILPFSTPGPSTSLQKASGALEHHHHHH* |
| αFGFR1c M15-αβKlotho M5) | C2144 | CGANQFTCHNTNICISQAWVCDGVPDCGDNSDEKNCSAPASEPPGSLGGGGSGGGGSGGGGSGGGGSCHSFNQFECRNGQCIPLHLVCDGVPDCGDNSDETDCGDSHILPFSTPGPSTSLQKASGALEHHHHHH* |
| αβKlotho M5)-αFGFR1c M15 | C2137 | CHSFNQFECRNGQCIPLHLVCDGVPDCGDNSDETDCGDSHILPFSTPGPSTCGANQFTCHNTNICISQAWVCDGVPDCGDNSDEKNCSAPASEPPGSLSLQKASGALEHHHHHH* |
| αβKlotho M5)-αFGFR1c M15 | C2138 | CHSFNQFECRNGQCIPLHLVCDGVPDCGDNSDETDCGDSHILPFSTPGPSTGCGGSCGANQFTCHNTNICISQAWVCDGVPDCGDNSDEKNCSAPASEPPGSLSLQKASGALEHHHHHH* |

FIG. 23A

| Binding Protein ID | Linker | Construct | ELISA EC50 (FGFR1c/Fc) | ELISA EC50 (FGFR1b/Fc) | ELISA EC50 (B-Klotho) | ELISA EC50 (R1c & B-K) | Mouse bKlotho cross-reactivity (alphascreen binding max signal) |
|---|---|---|---|---|---|---|---|
| aFGFR1cM15-abKlotho M01 | Native | C2114 | 2.00 | 1.00 | 10.00 | 7.00 | 90,000 |
| aFGFR1cM15-abKlotho M01 | Native + (1XG4S) | C2139 | N/A | N/A | N/A | N/A | 150,000 |
| aFGFR1cM15-abKlotho M01 | Native + (2XG4S) | C2140 | 4.00 | 2.00 | 19.00 | 13.00 | 240,000 |
| aFGFR1cM15-abKlotho M01 | Native + (3XG4S) | C2122 | 6.00 | 4.00 | 20.00 | 16.00 | 95,000 |
| abKlotho M01-aFGFR1c M15 | Native | C2130 | 44.00 | 22.00 | 32.00 | 17.00 | 4,000 |
| abKlotho M01-aFGFR1c M15 | Native + (2XG4S) | C2131 | 23.00 | 23.00 | 32.00 | 19.00 | 3,000 |
| abKlotho M01-aFGFR1c M15 | Native + (3XG4S) | C2132 | 4.00 | 3.00 | 20.00 | 16.00 | no binding |

FIG. 23B

| Binding Protein ID | Linker | Construct | ELISA EC50 (FGFR1cFc) | ELISA EC50 (F3FR1bFc) | ELISA EC50 (B-Klotho) | ELISA EC50 (R1c & B-K) | Mouse bKlotho cross-reactivity (alphascreen binding max signal) |
|---|---|---|---|---|---|---|---|
| aFGFR1cM15-abKlotho M42 | Native | C2116 | 3.00 | 2.00 | 1.00 | 26.00 | 220,000 |
| aFGFR1cM15-abKlotho M42 | Native + (1XG4S) | C2120 | 3.00 | 2.00 | 2.00 | 7.00 | 290,000 |
| aFGFR1cM15-abKlotho M42 | Native + (2XG4S) | C2141 | 7.00 | 3.00 | 7.00 | 12.00 | 80,000 |
| aFGFR1cM15-abKlotho M42 | Native + (3XG4S) | C2142 | 3.00 | 2.00 | 1.00 | 8.00 | 40,000 |
| abKlotho M42-aFGFR1c M15 | Native | C2133 | 17.00 | 11.00 | 230.00 | 5.00 | no binding |
| abKlotho M42-aFGFR1c M15 | Native + (1XG4S) | C2134 | 5.00 | 3.00 | 25.00 | 8.00 | no binding |
| abKlotho M42-aFGFR1c M15 | Native + (2XG4S) | C2135 | 6.00 | 4.00 | 54.00 | 14.00 | no binding |
| abKlotho M42-aFGFR1c M15 | Native + (3XG4S) | C2136 | 13.00 | 10.00 | 120.00 | 19.00 | no binding |

FIG. 23C

| Binding Protein ID | Linker | Construct | ELISA EC50 (FGFR1c/Fc) | ELISA EC50 (FGFR1b/Fc) | ELISA EC50 (B-Klotho) | ELISA reactivity (alphascreen) (R1c & B-K) | Mouse bKlotho cross-reactivity binding max signal |
|---|---|---|---|---|---|---|---|
| aFGFR1c M15-abKlotho M50 | Native | C2117 | 18.00 | 16.00 | 4.00 | 20.00 | no binding |
| aFGFR1c M15-abKlotho M50 | Native + (1XG4S) | C2121 | 12.00 | 16.00 | 25.00 | 14.00 | no binding |
| aFGFR1c M15-abKlotho M50 | Native + (2XG4S) | C2143 | 10.00 | 11.00 | 27.00 | 29.00 | no binding |
| aFGFR1c M15-abKlotho M50 | Native + (3XG4S) | C2144 | 41.00 | 17.00 | 17.00 | 15.00 | no binding |
| abKlotho M50-aFGFR1c M15 | Native | C2137 | 44.00 | 46.00 | 8.00 | 19.00 | no binding |
| abKlotho M50-aFGFR1c M15 | Native + (1XG4S) | C2138 | 49.00 | 36.00 | 10.00 | 22.00 | no binding |

FIG. 24B
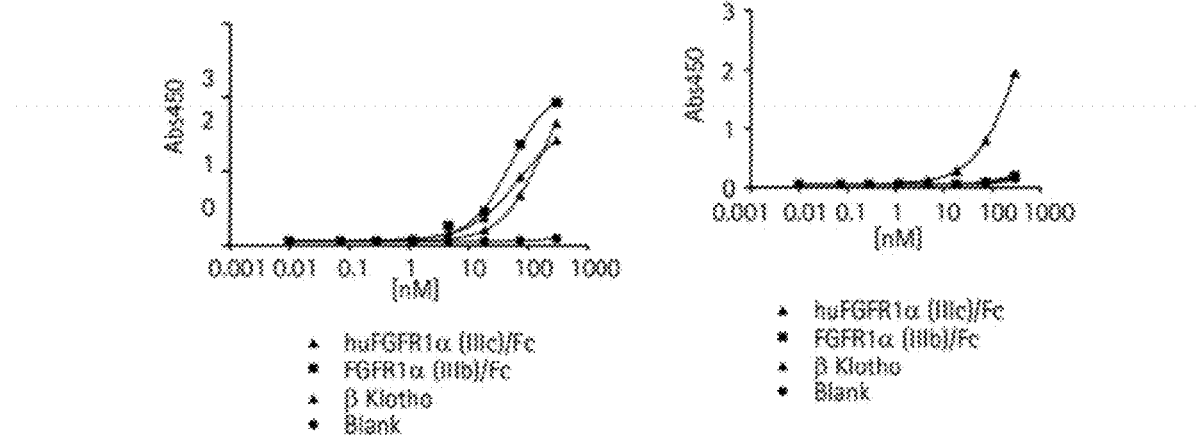
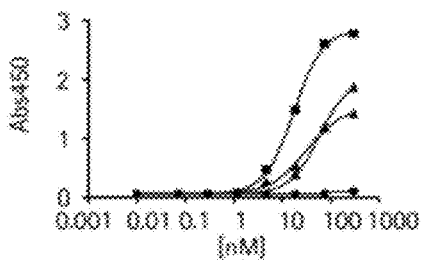
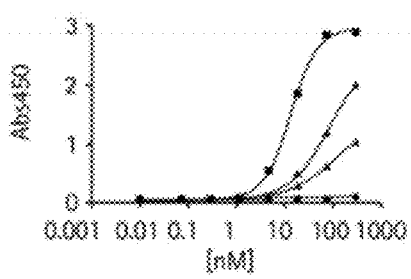

FIG. 24C
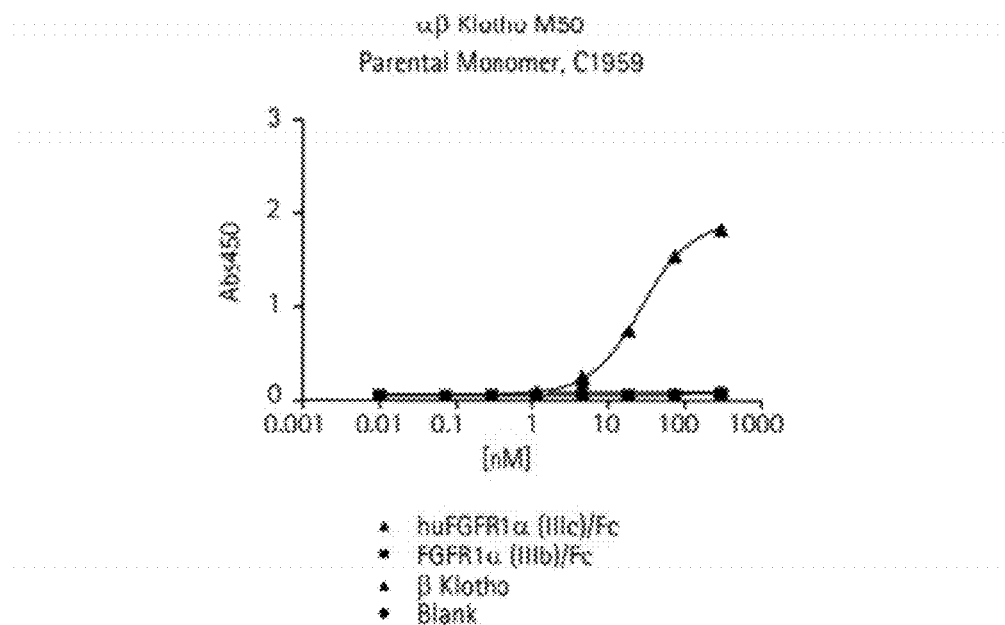
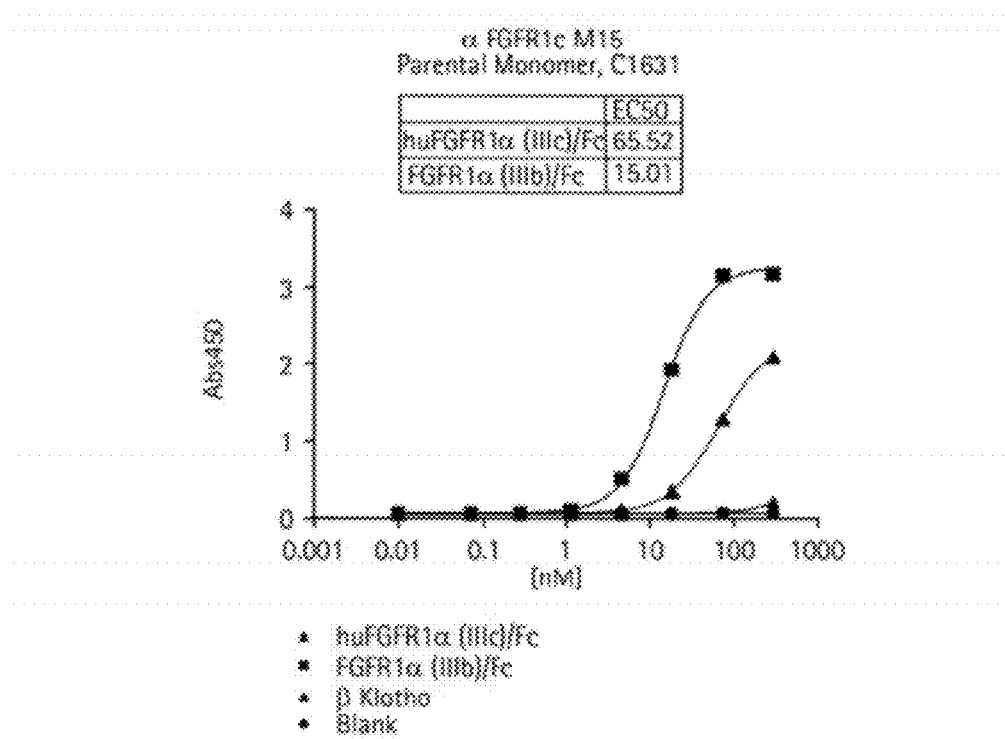

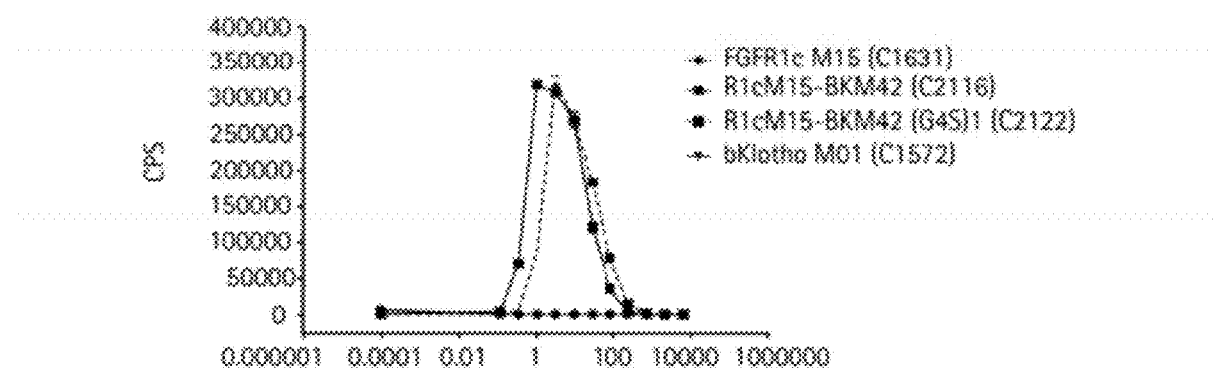
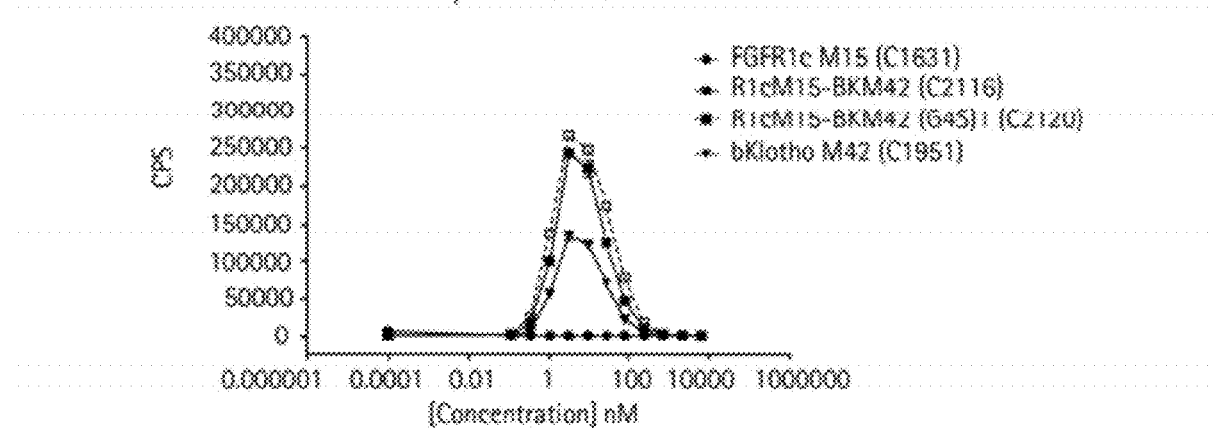
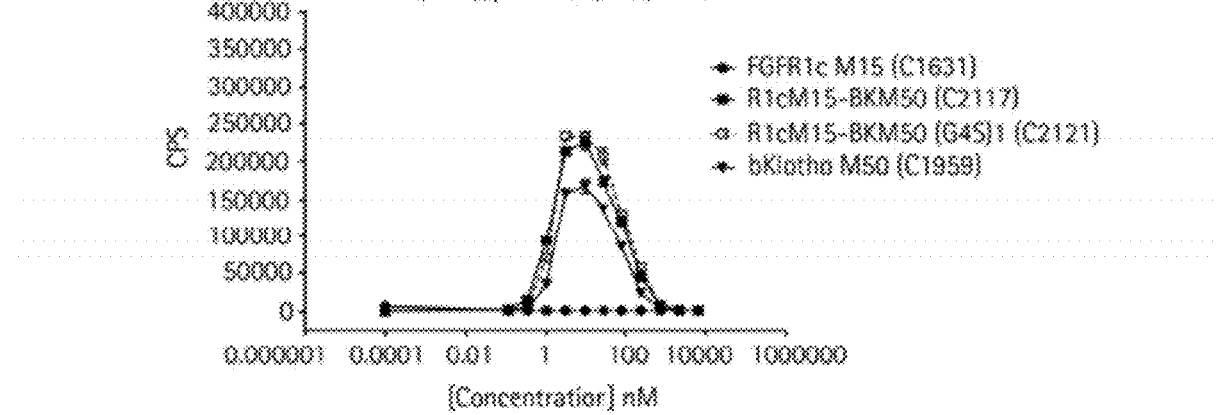
FIG. 25A

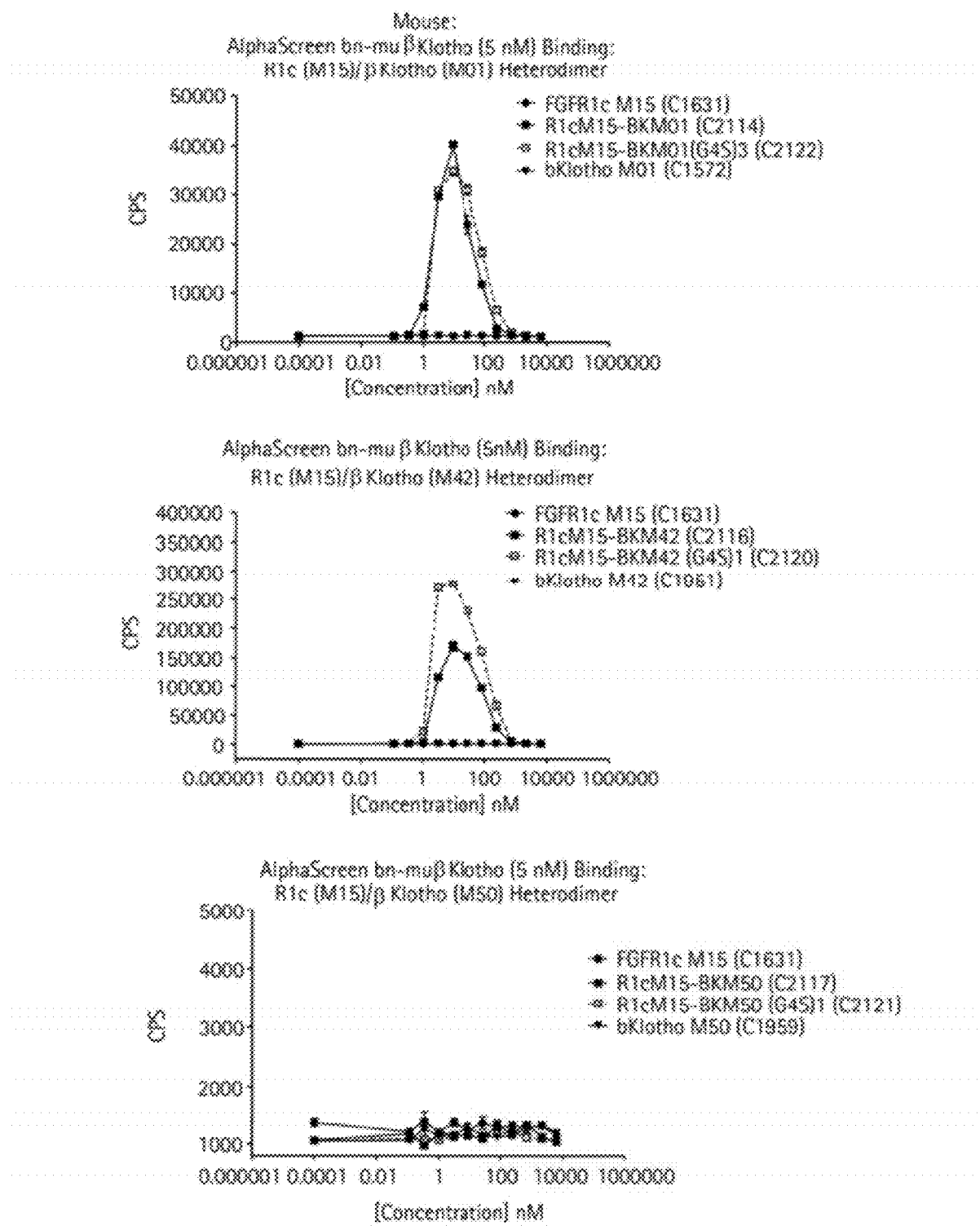

FIG. 26A
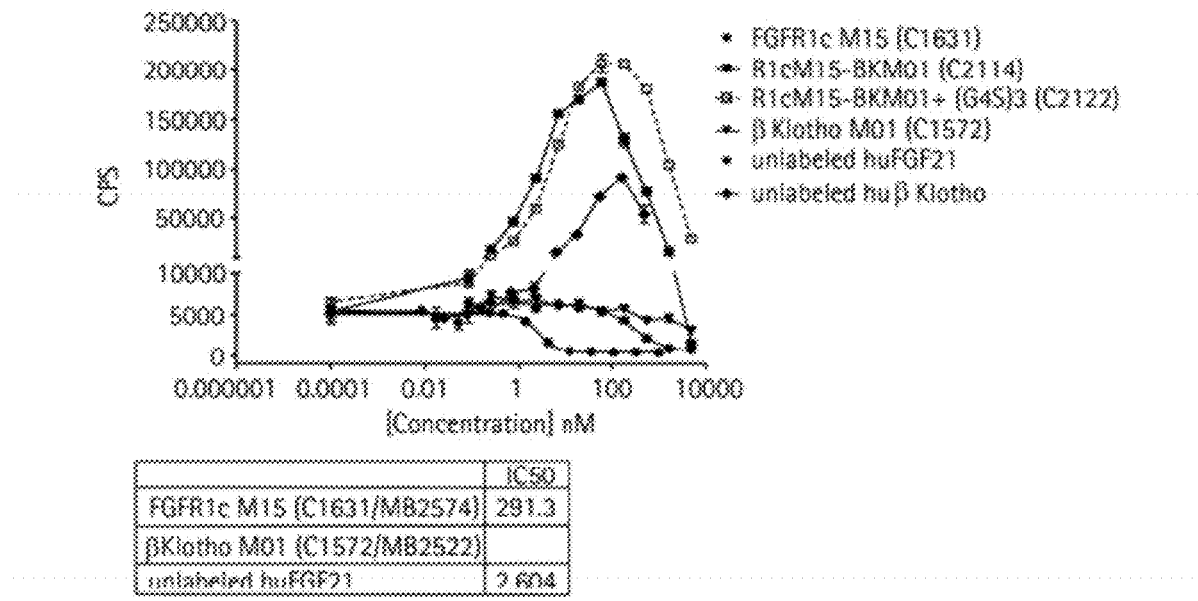
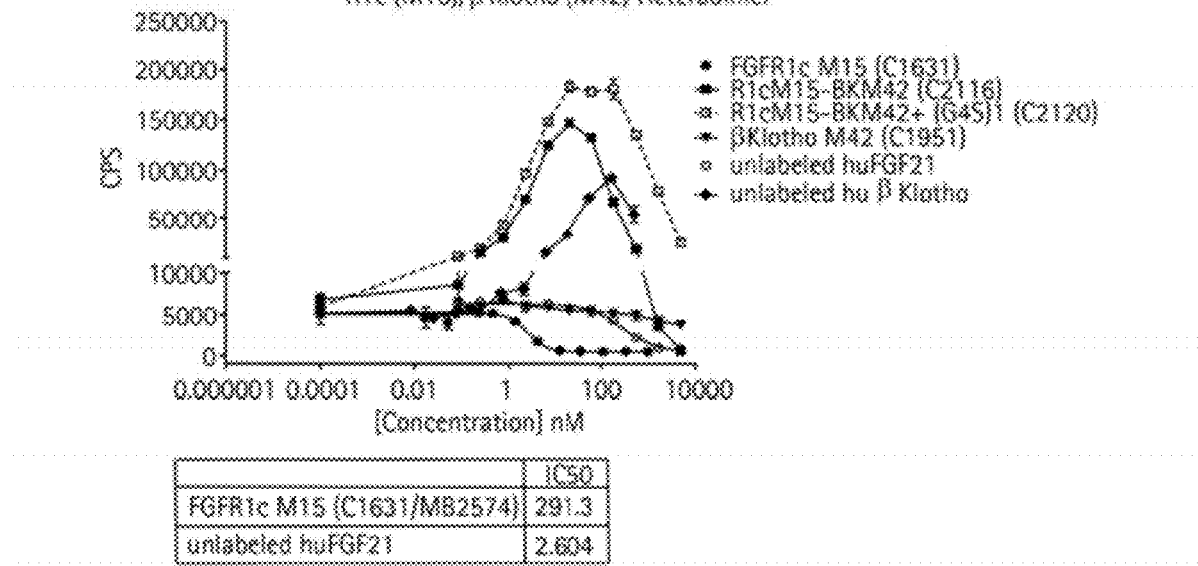

FIG. 26B
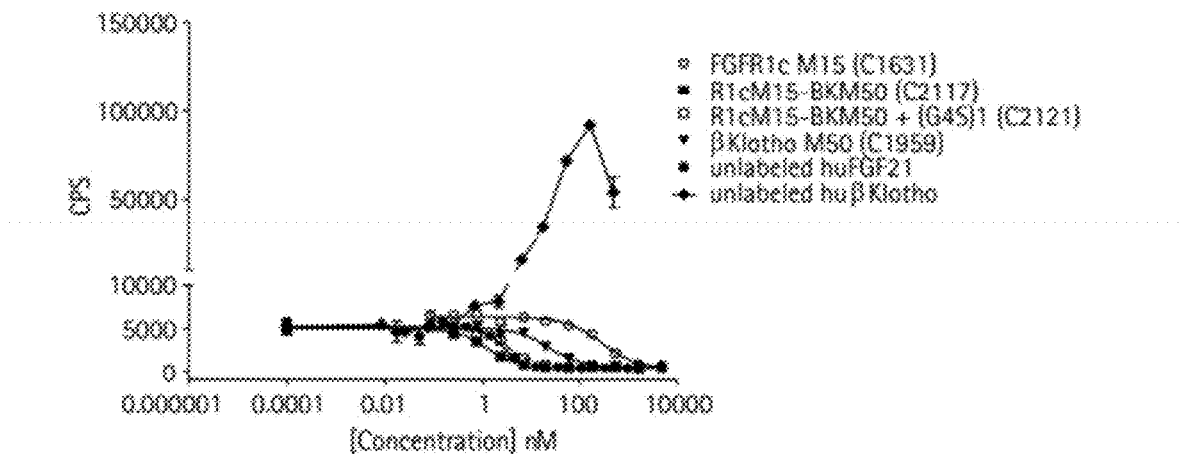
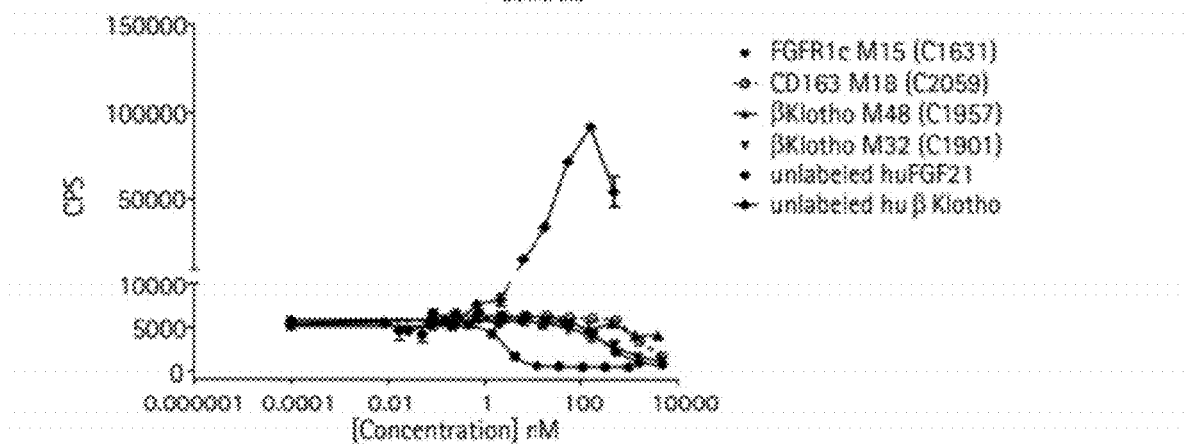

FIG. 27A
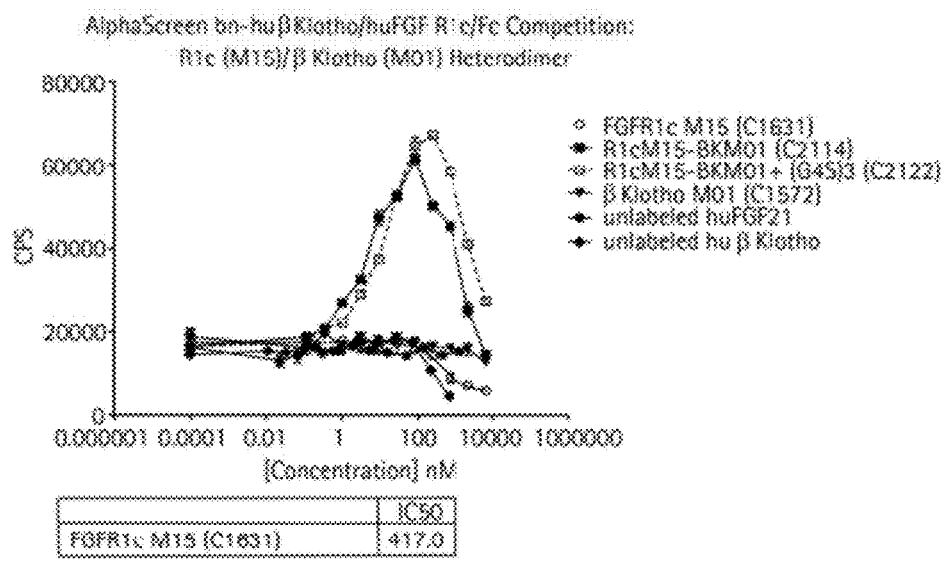
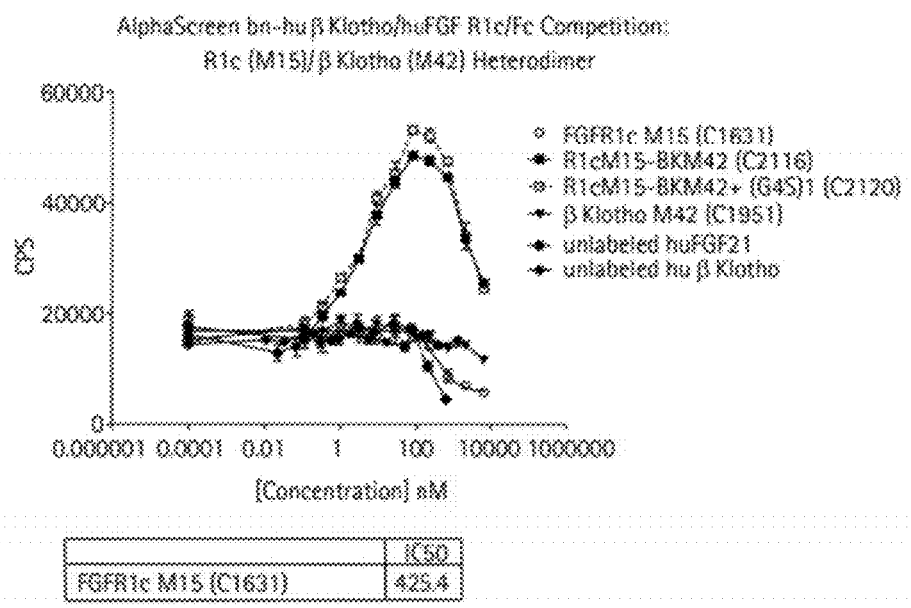

FIG. 27B
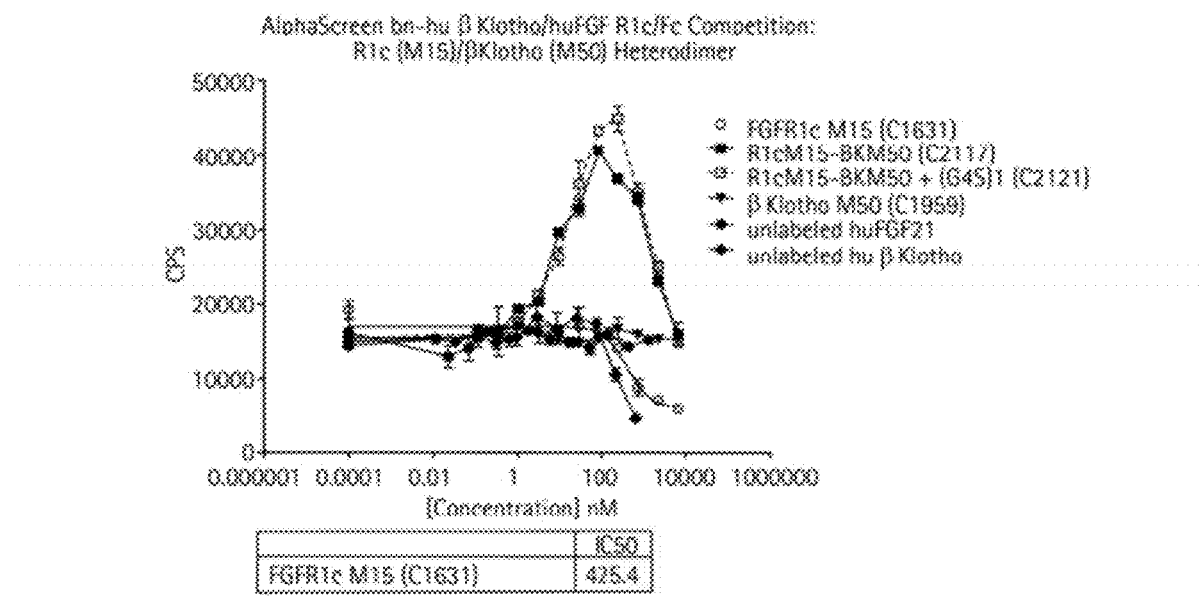
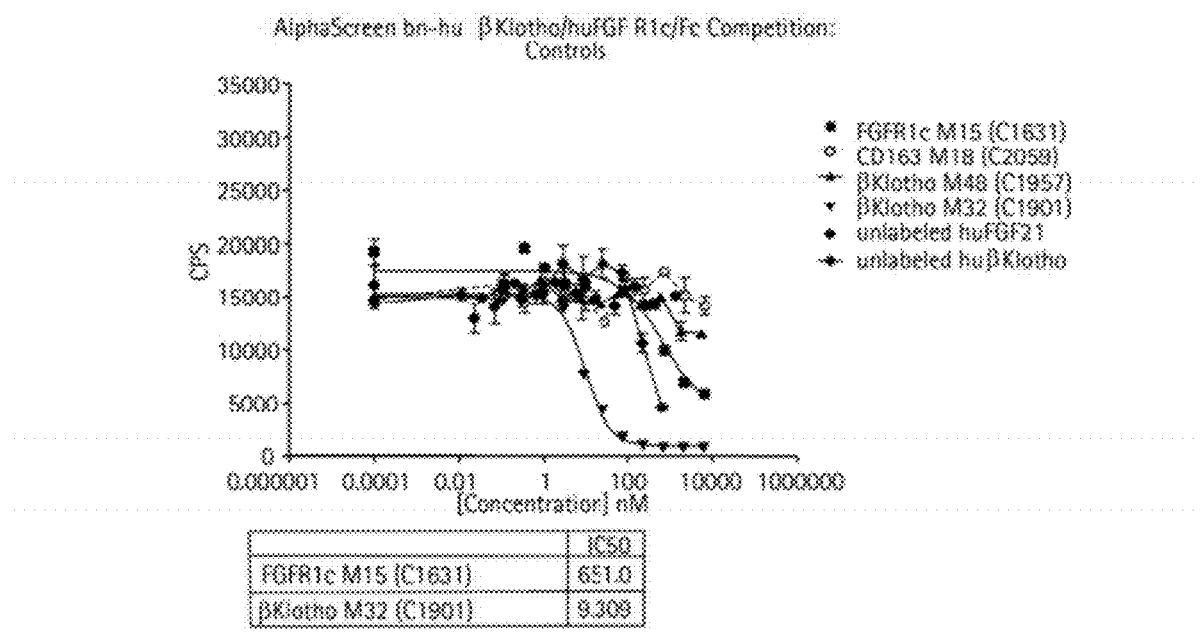

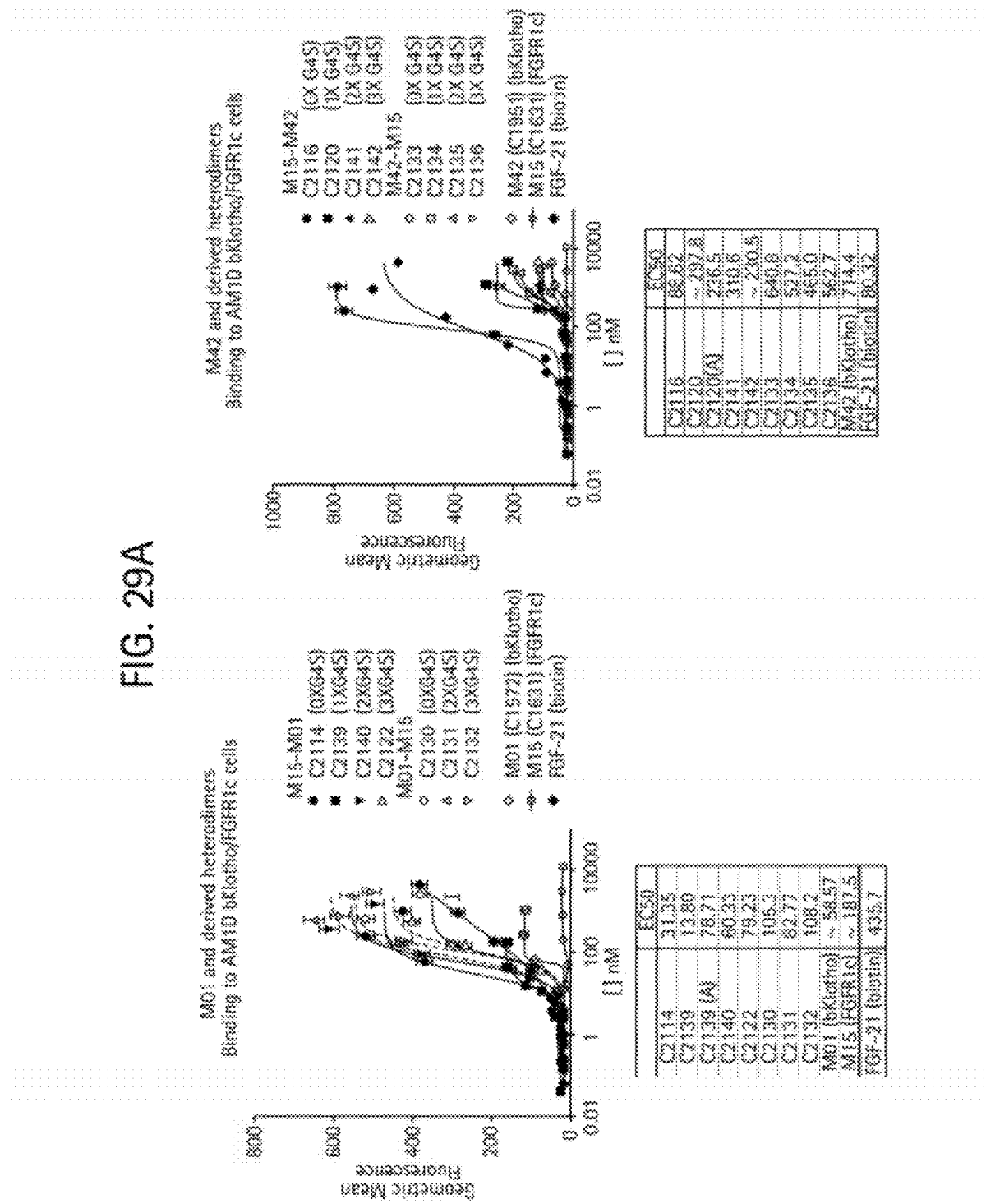

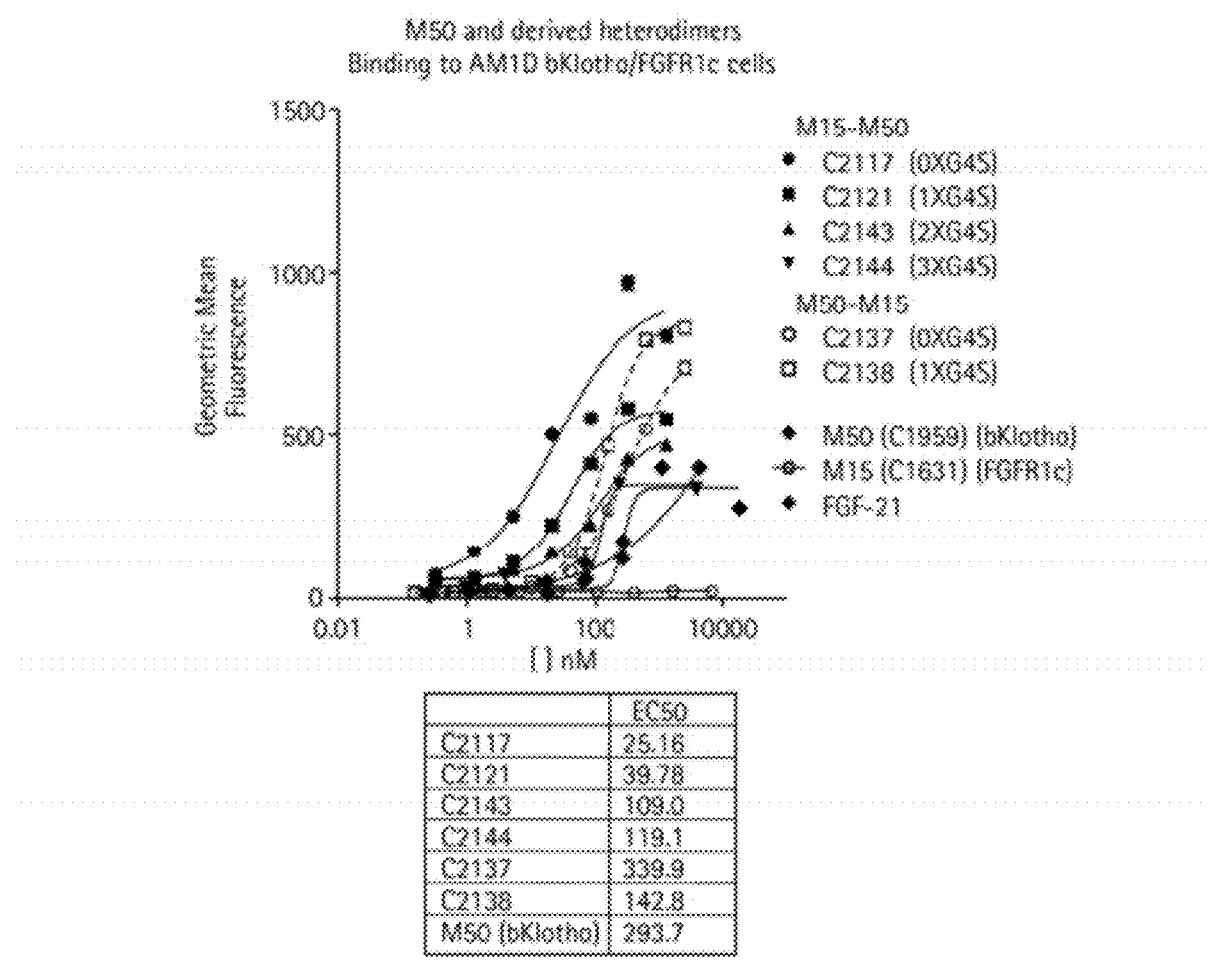

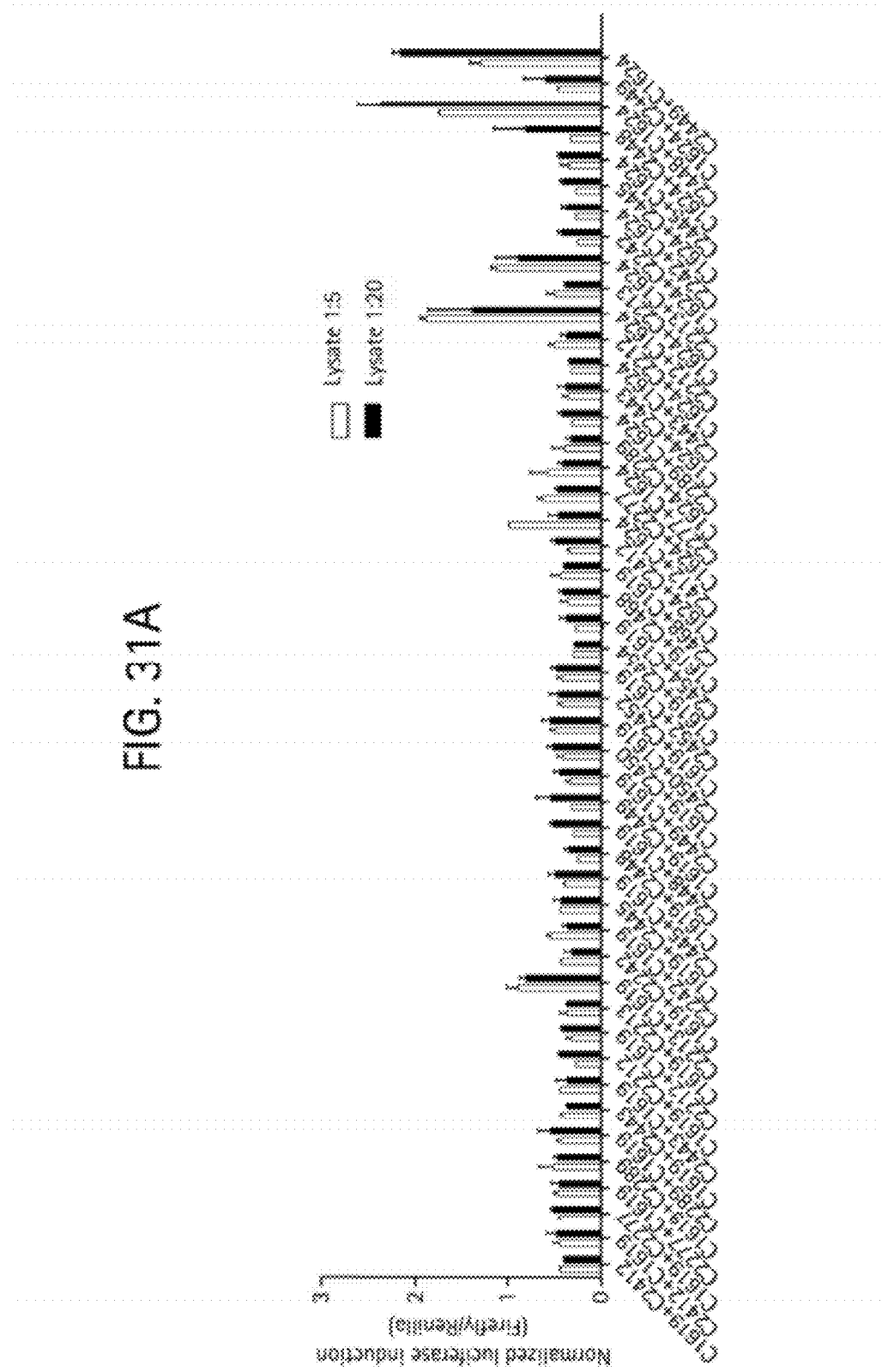

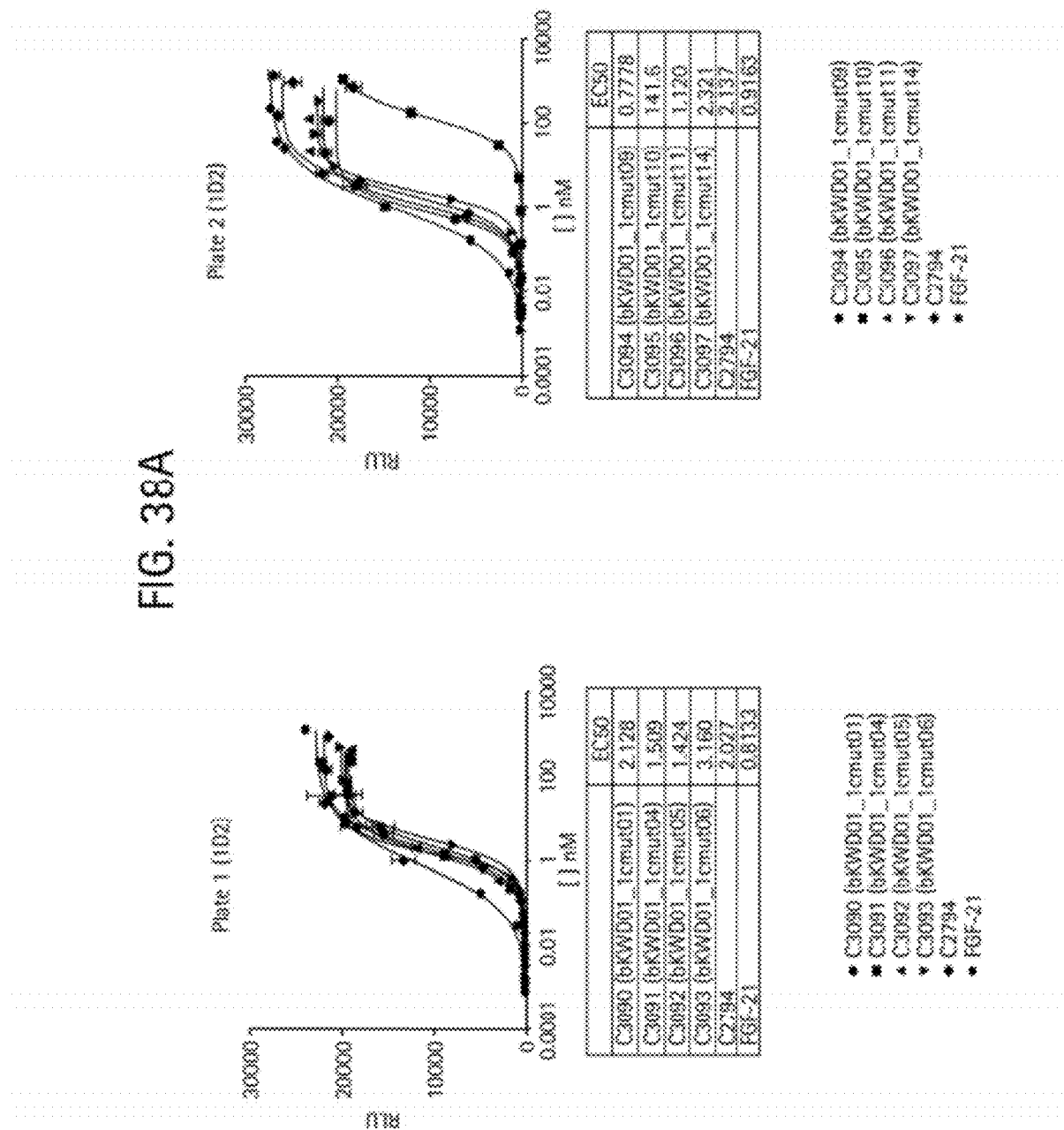

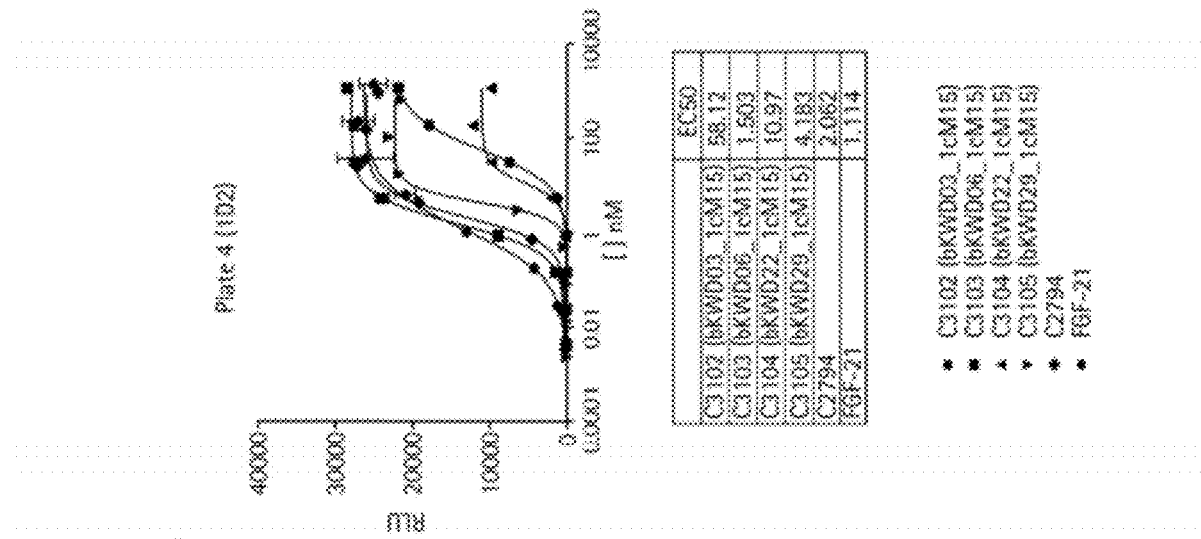
FIG. 38B
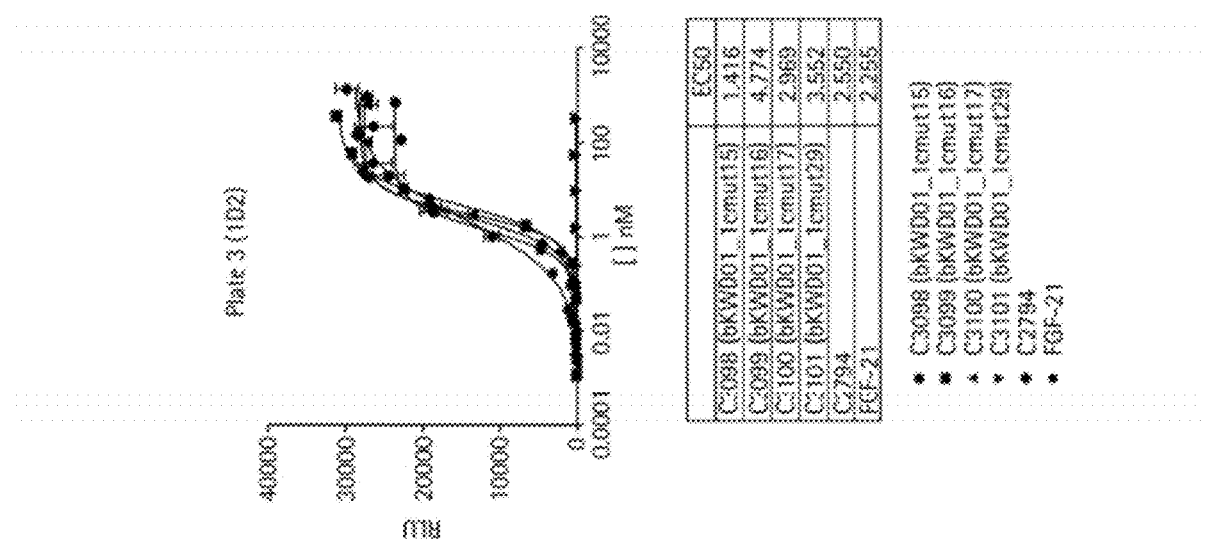

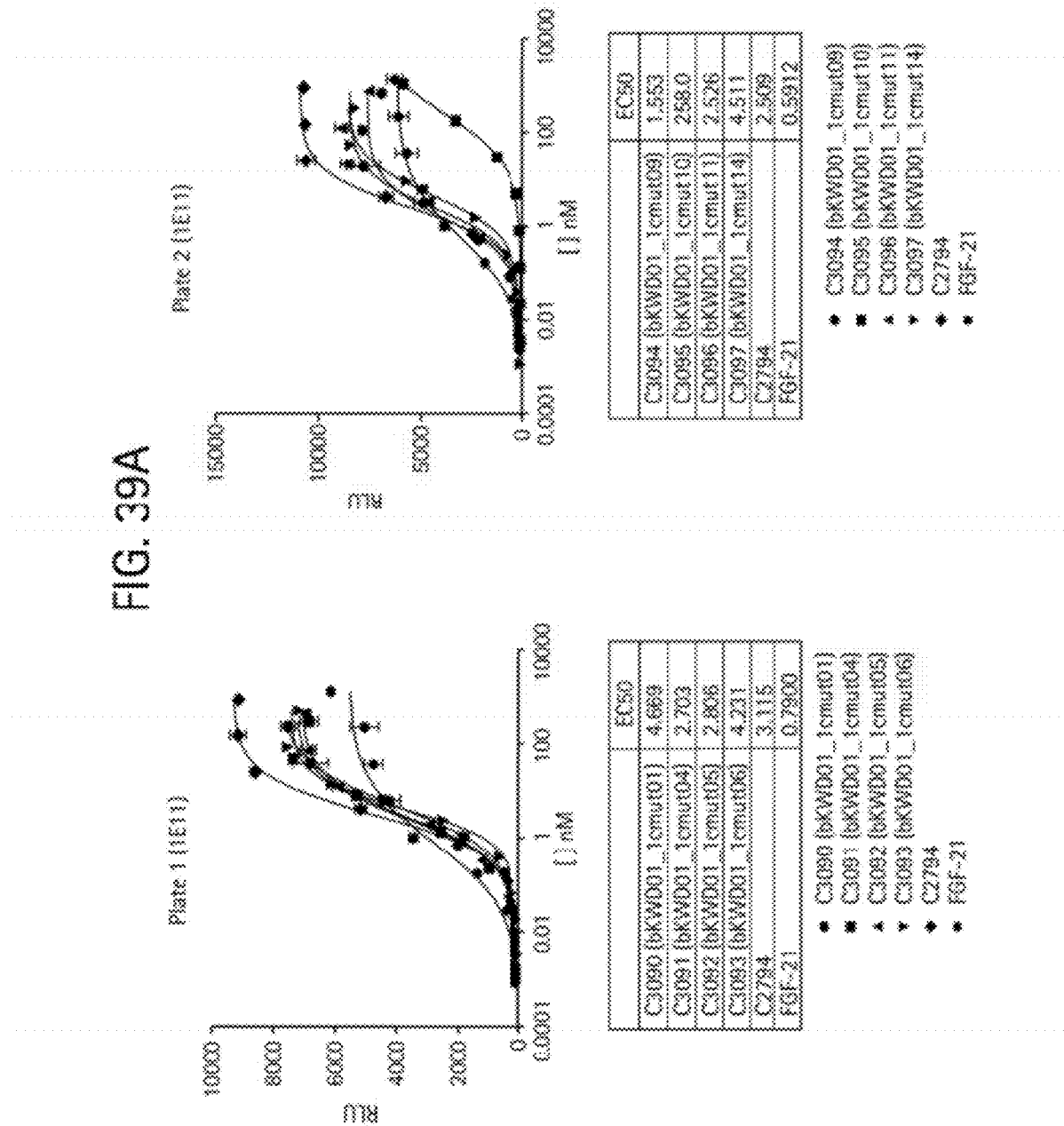

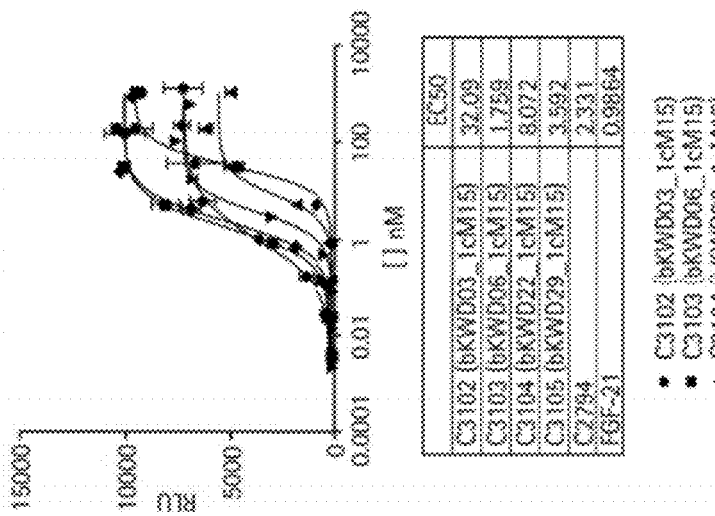
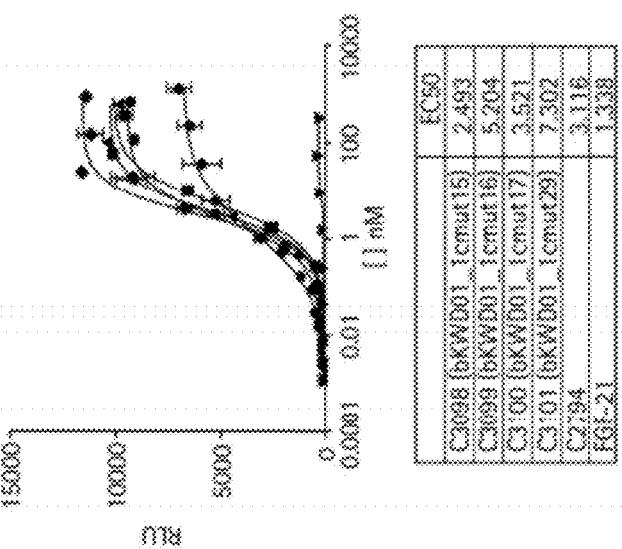
FIG. 39B

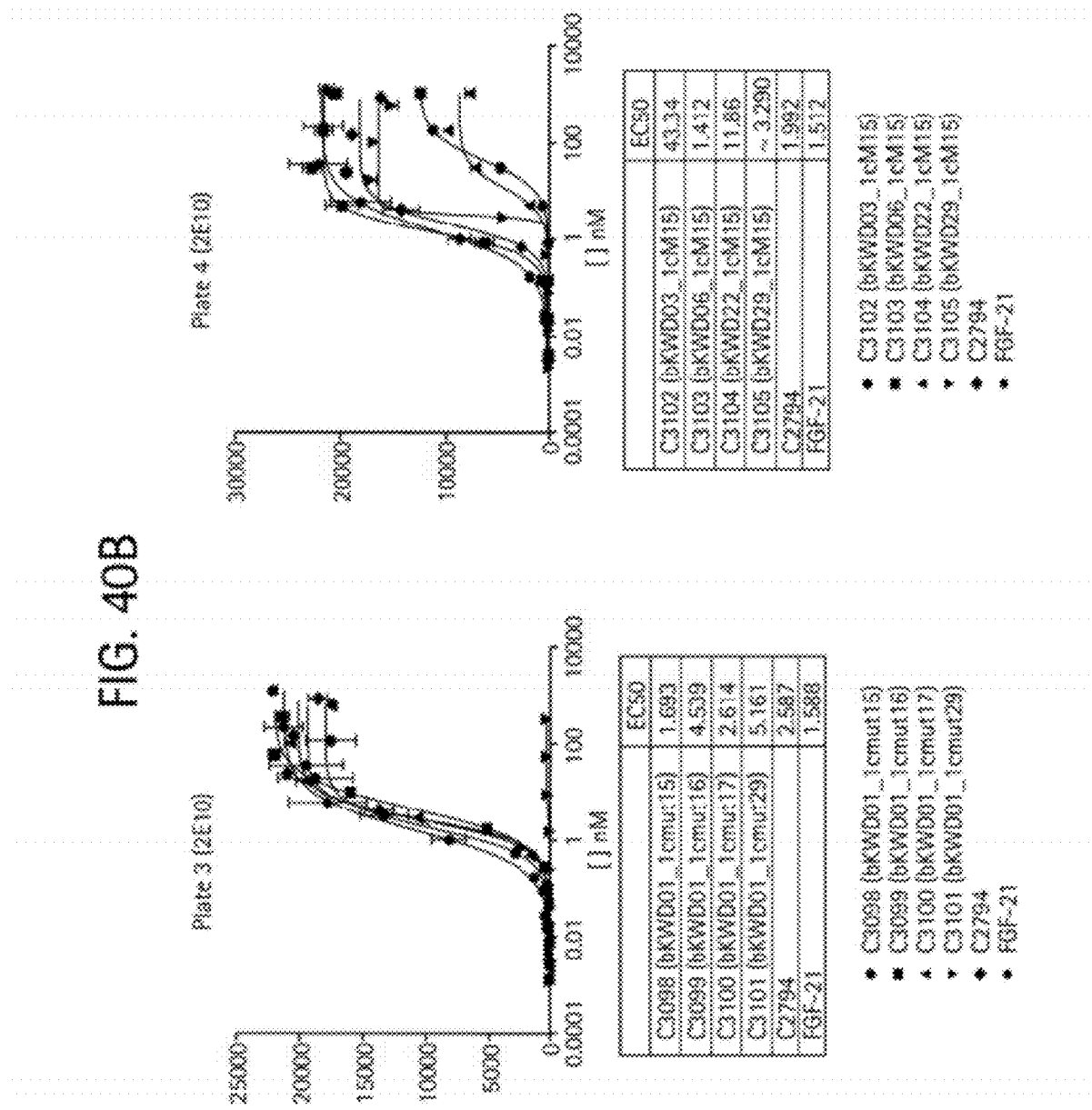

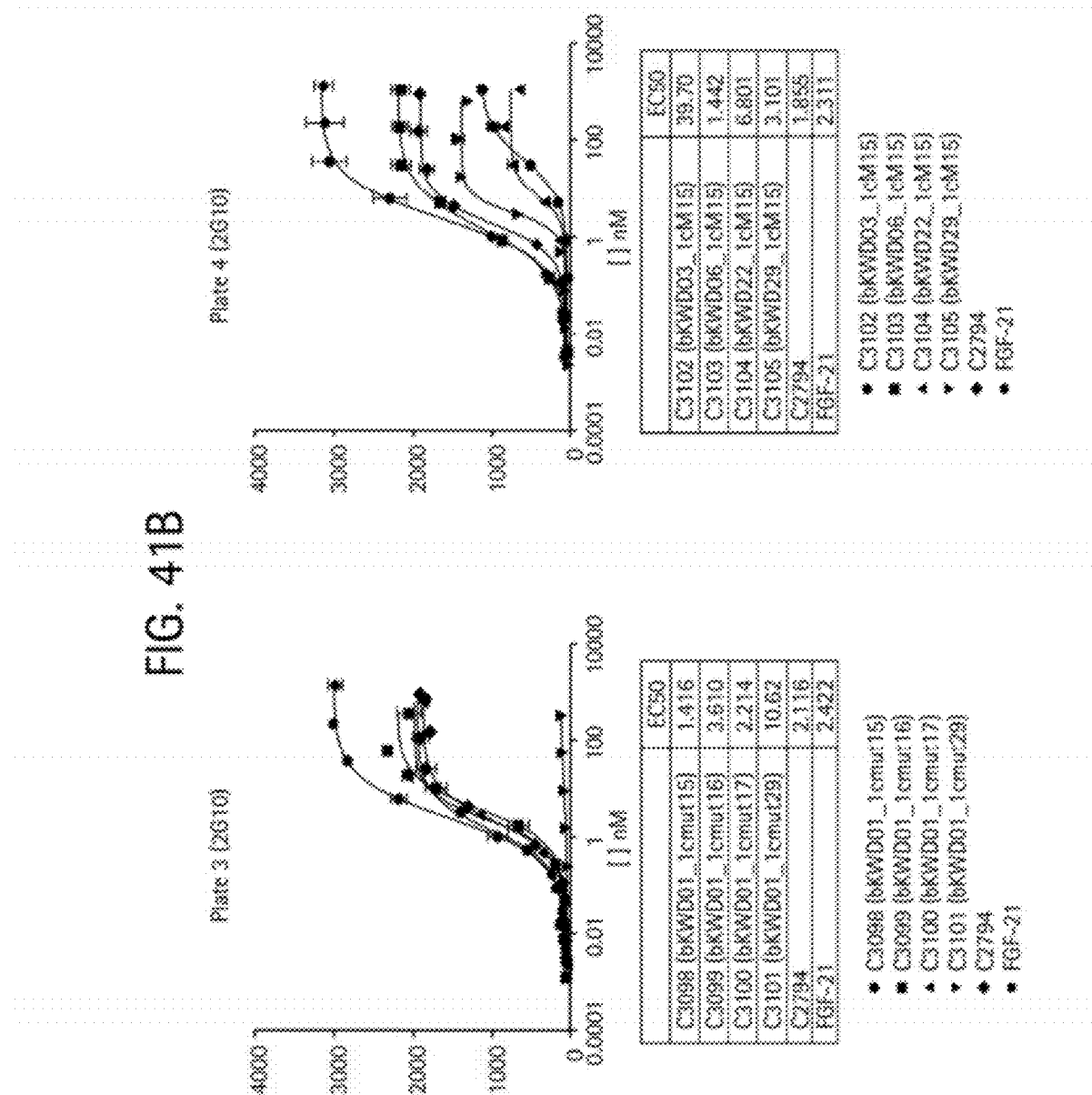

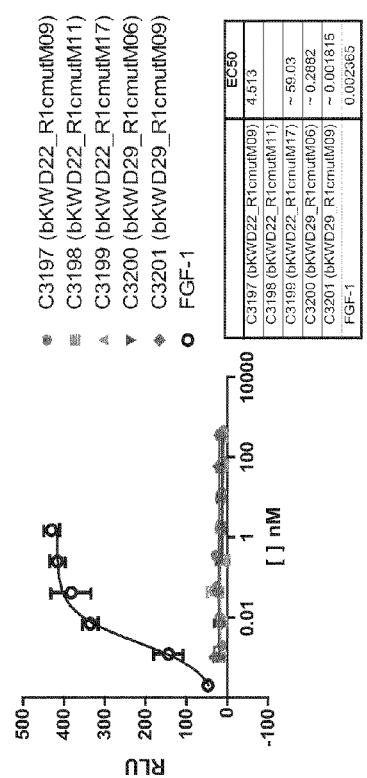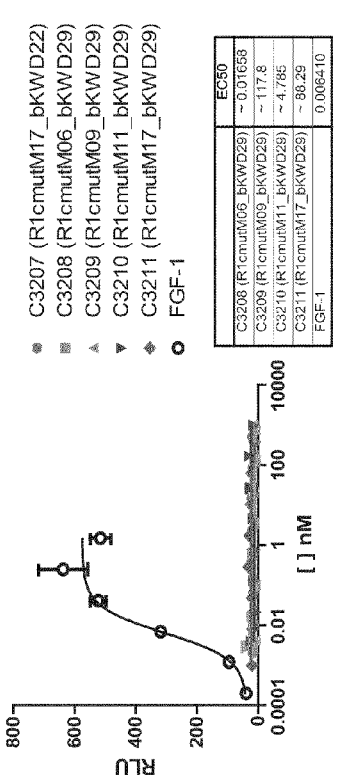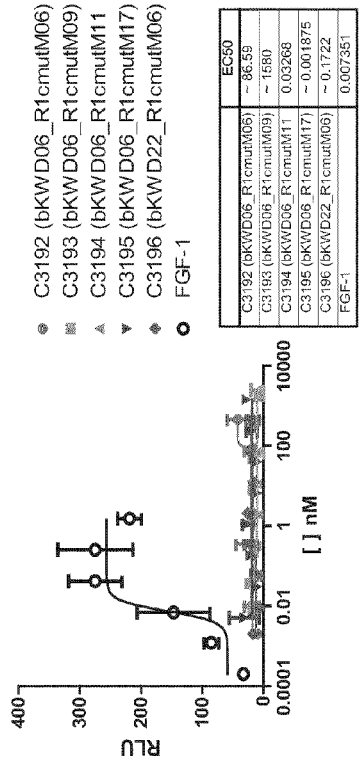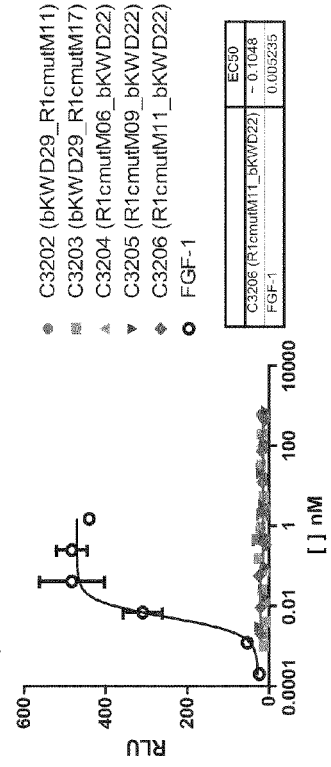
Figure 46

FIG. 47B
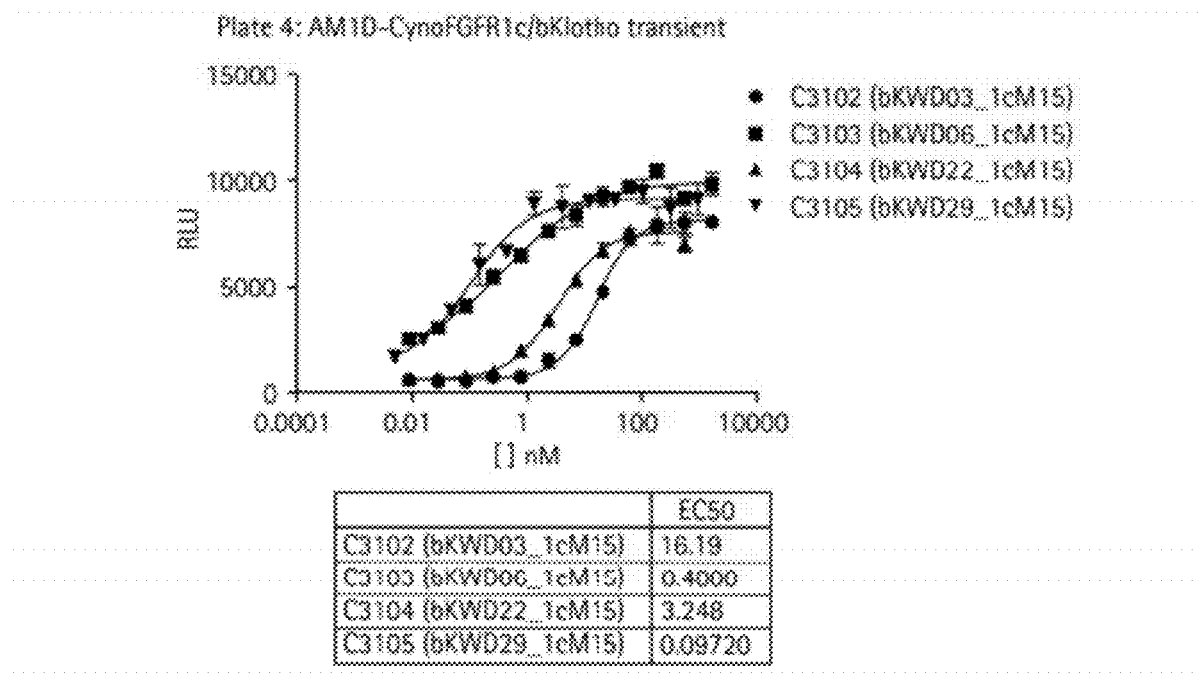
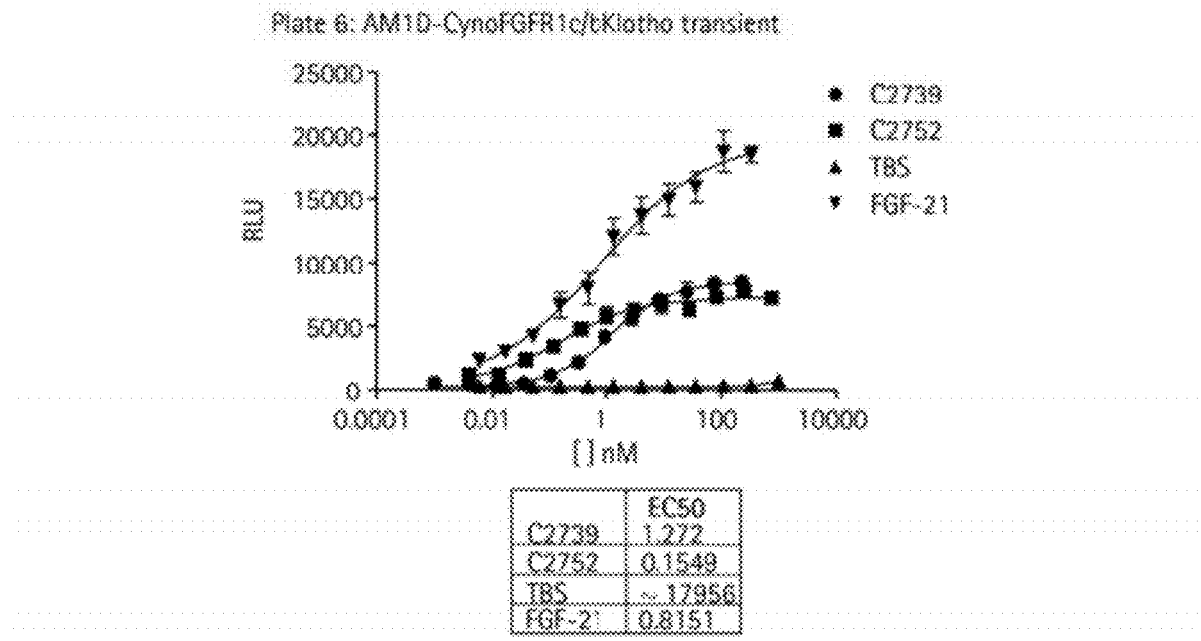

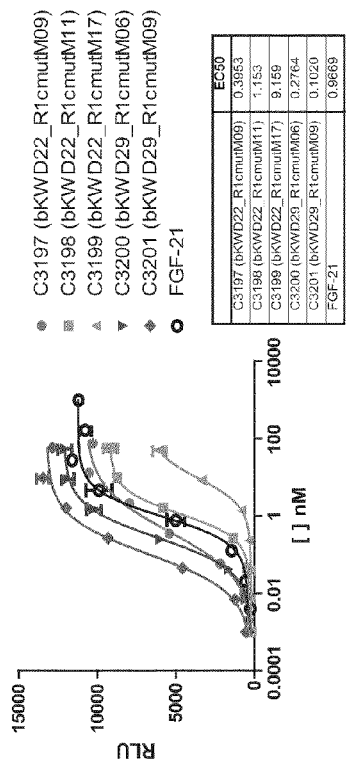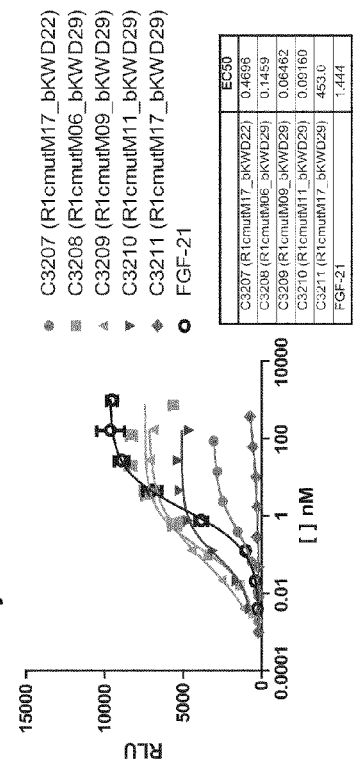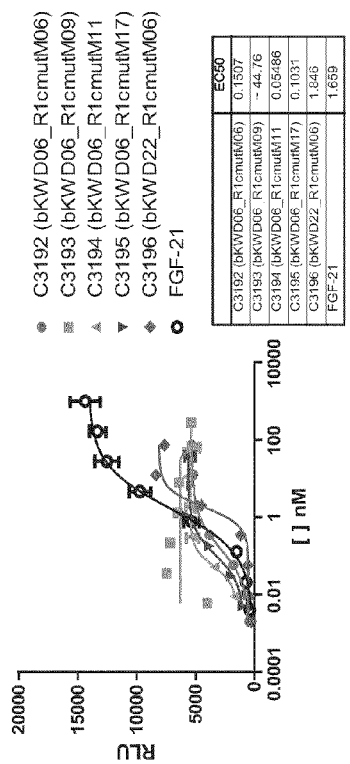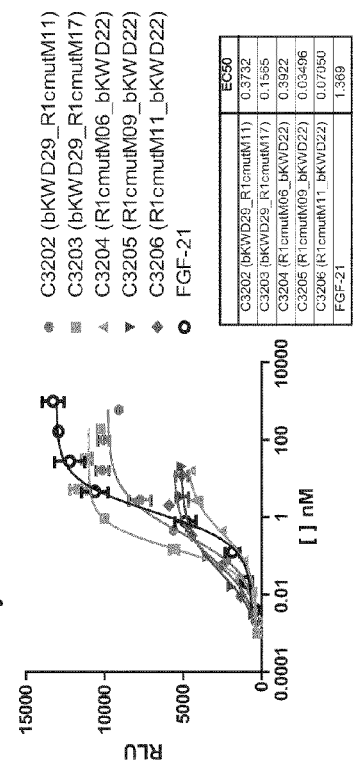
Figure 48

FIG. 49A
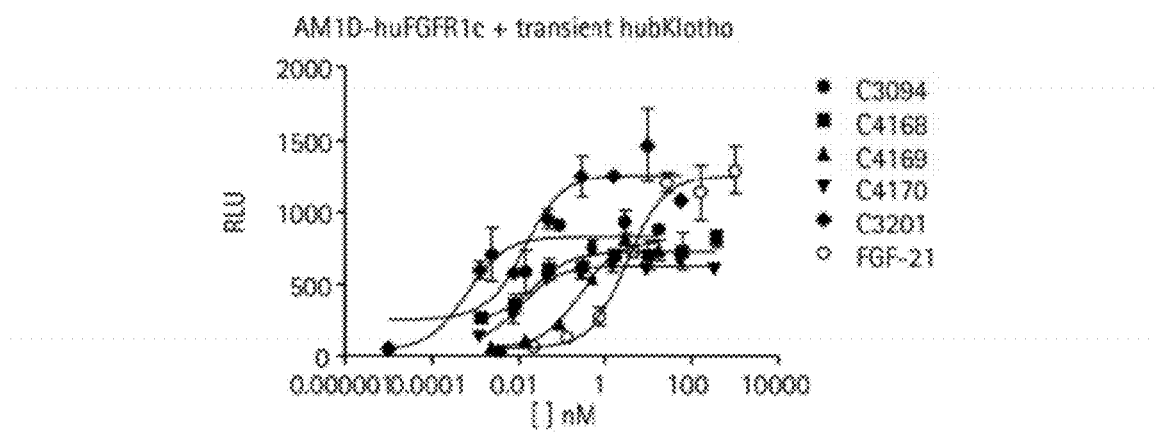
C3094 = bKWD01::R1cmutM09
C4168 = bKWD02::R1cmutM09
C4169 = bKWD03::R1cmutM09
C4170 = bKWD04::R1cmutM09
C3201 = bKWD29::R1cmutM09
|  | EC50 |
| --- | --- |
| C3094 | 0.0006329 |
| C4168 | 0.02113 |
| C4169 | 0.2548 |
| C4170 | 0.01069 |
| C3201 | 0.01365 |
| FGF-21 | 3.330 |
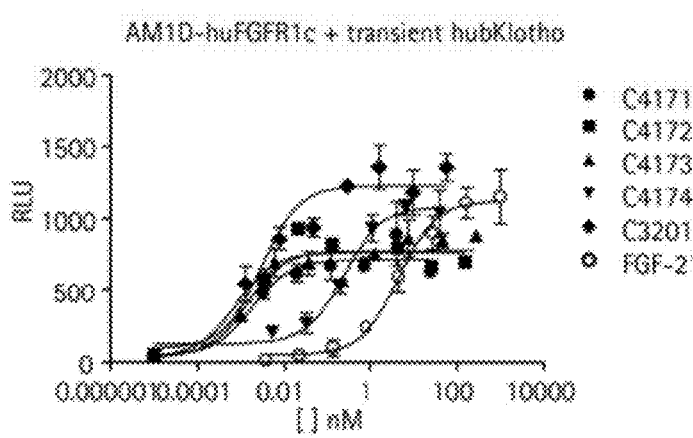
C4171 = bKWD05::R1cmutM09
C4172 = bKWD06::R1cmutM09
C4173 = bKWD08::R1cmutM09
C4174 = bKWD21::R1cmutM09
C3201 = bKWD29; R1cmutM09
|  | EC50 |
| --- | --- |
| C4171 | 0.001854 |
| C4172 | 0.0007887 |
| C4173 | 0.001420 |
| C4174 | 0.2274 |
| C3201 | 0.007803 |
| FGF-21 | 4.633 |

FIG. 50A
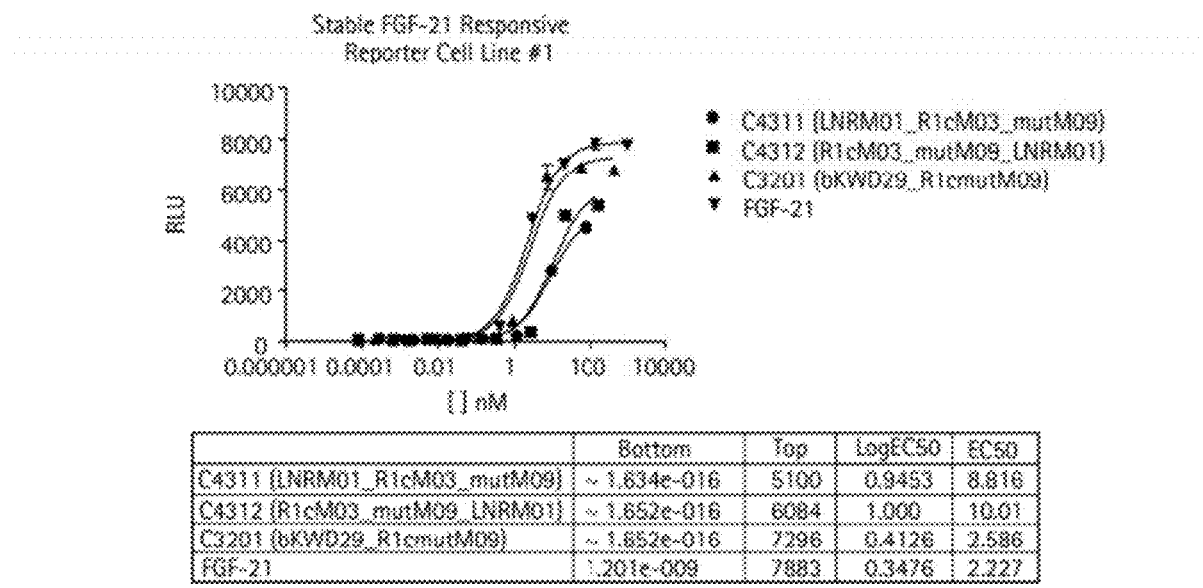
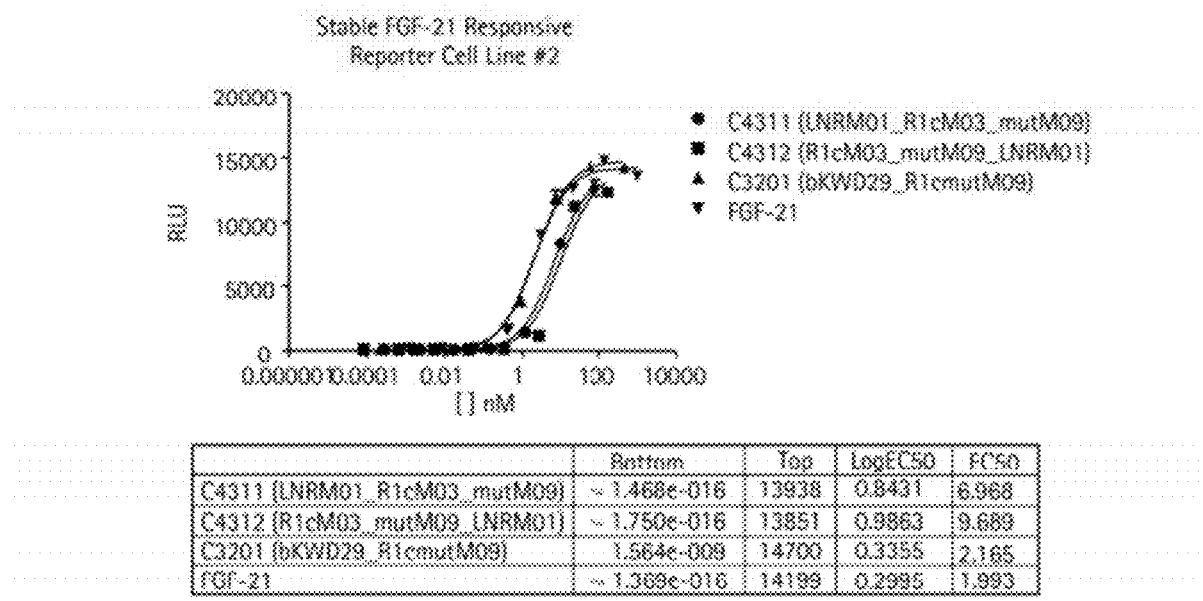

FIG. 50B
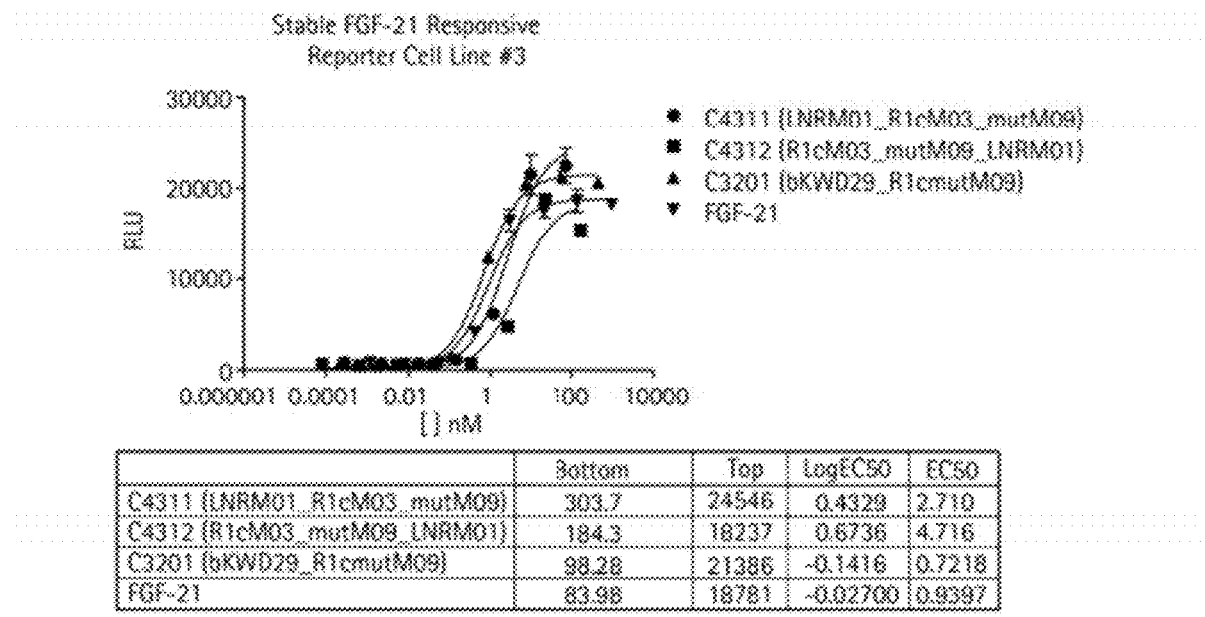
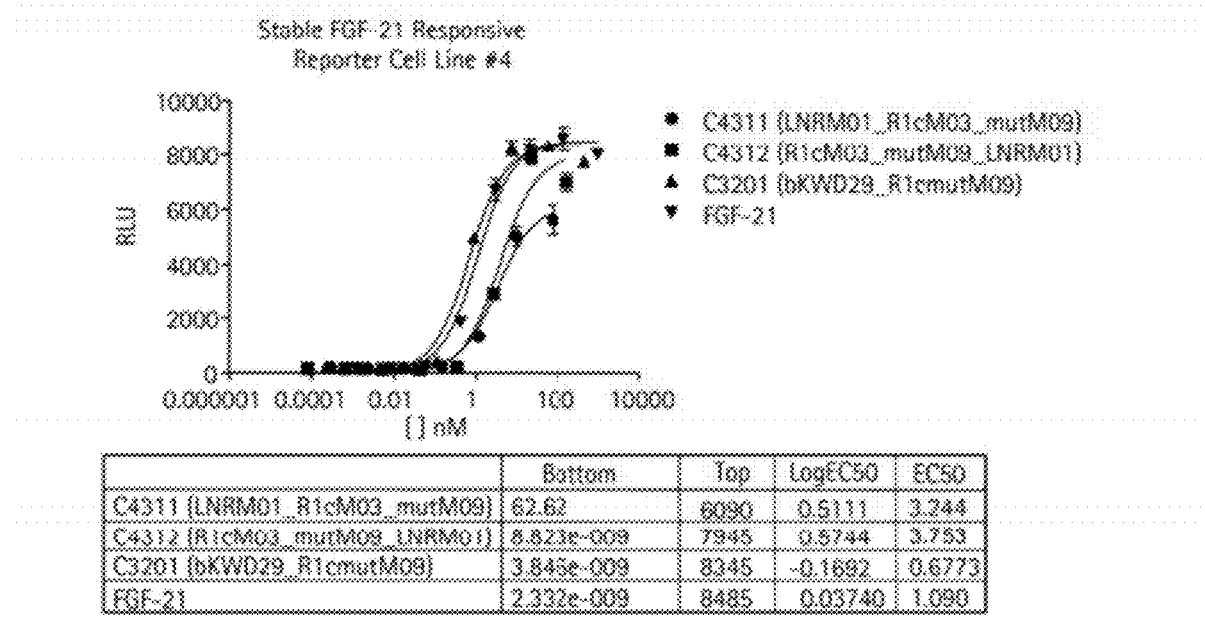

BINDING PROTEINS THAT BIND TO HUMAN FGFR1C, HUMAN β-KLOTHO AND BOTH HUMAN FGFR1C AND HUMAN β-KLOTHO

This application claims the benefit of U.S. Provisional Application No. 61/381,364 filed Sep. 9, 2010 and U.S. Provisional Application No. 61/266,061 filed Dec. 2, 2009, which are incorporated by reference herein.

SEQUENCE LISTING

The instant application contains a Sequence Listing which has been submitted via EFS-Web and is hereby incorporated by reference in its entirety. Said ASCII copy, created on Nov. 12, 2010, is named A1518NP.txt, and is 1 Megabyte in size.

BACKGROUND OF THE INVENTION

Fibroblast Growth Factor 21 (FGF21) is a secreted polypeptide that belongs to a subfamily of Fibroblast Growth Factors (FGFs) that includes FGF19, FGF21, and FGF23 (Itoh et al., 2004, *Trend Genet.* 20: 563-69). FGF21 is an atypical FGF in that it is heparin independent and functions as a hormone in the regulation of glucose, lipid, and energy metabolism.

FGF21 is highly expressed in liver and pancreas and is the only member of the FGF family to be primarily expressed in liver. Transgenic mice overexpressing FGF21 exhibit metabolic phenotypes of slow growth rate, low plasma glucose and triglyceride levels, and an absence of age-associated type 2 diabetes, islet hyperplasia, and obesity. Pharmacological administration of recombinant FGF21 protein in rodent and primate models results in normalized levels of plasma glucose, reduced triglyceride and cholesterol levels, and improved glucose tolerance and insulin sensitivity. In addition, FGF21 reduces body weight and body fat by increasing energy expenditure, physical activity, and metabolic rate. (Xu et al. 2009 *Diabetes* 58:250-259) There is also evidence that FGF21 may have a protective effect in acute pancreatitis (Johnson et al. 2009 *Gastroenterology* 137(5):1795-1804).

Experimental research provides support for the pharmacological administration of FGF21 for the treatment of type 2 diabetes, obesity, dyslipidemia, and other metabolic conditions or disorders in humans. (Xu et al., 2009 *Am J Physiol Endocrinol Metab.* 297:E1105-E1114; Reviewed in Ryden 2009 *Cell Mol Life Sci.* 66:2067-73)

FGF21 is a liver derived endocrine hormone that stimulates glucose uptake in adipocytes and lipid homeostasis through the activation of its receptor. Interestingly, in addition to the canonical FGF receptor, FGFR1c, the FGF21 receptor also consists of the membrane associated β-Klotho as an essential cofactor. Activation of the FGF21 receptor leads to multiple beneficial effects on a variety of metabolic parameters.

In mammals, FGFs mediate their action via a set of four FGF receptors FGFR1-4 that in turn are expressed in multiple spliced variants. Each FGF receptor contains an intracellular tyrosine kinase domain that is activated upon ligand binding, leading to downstream signaling pathways involving MAPKs (Erk1/2), RAF1, AKT1 and STATs. (Kharitonenkov et al., 2008 *BioDrugs* 22:37-44). Several reports suggested that the "c"-reporter splice variants of FGFR1-3 exhibit specific affinity to βKlotho and could act as endogenous receptor for FGF21 (Kurosu et al., 2007 *J. Biol. Chem.* 282:26687-26695); Ogawa et al., 2007 *Proc. Natl. Acad. Sci. USA* 104: 7432-7437; Kharitonenkov et al., 2008 *J. Cell Physiol.* 215, 1-7). In the liver, which abundantly expresses both βKlotho and FGFR4, FGF21 does not induce phosphorylation of MAPK albeit the strong binding of FGF21 to the βKlotho-FGFR4 complex. In 3T3-L1 cells and white adipose tissue, FGFR1 is by far the most abundant receptor, and it is therefore most likely that FGF21's main functional receptors in this tissue are the βKlotho-FGFR1c complexes.

The present disclosure provides binding proteins, including bispecific binding proteins, that can activate FGF21-mediated signaling, i.e., an agonistic binding protein that mimics the function of FGF21. Such a binding protein can be a molecule with FGF21-like activity and selectivity but with added therapeutically desirable characteristics such as protein stability, low immunogenicity, ease of production and a desirable in vivo half-life.

BRIEF SUMMARY OF THE INVENTION

In one aspect of the present disclosure a binding protein that selectively binds β-Klotho is provided. In one embodiment the binding protein comprises one or more of:

```
                                        (SEQ ID NO: 254)
C[AGP][APS][DGN][EQ]F[QRT]C[GNRS][GNS][GT][GKQS]

[-IK]C[ILV]P[LQRV][AEHP]W[LRV]CDG[DLV][DN]DCGD

[GN]SDE[AEKPS][GLPS][-AEV][-IT]C;

(SEQ ID NO: 597)
CLPDEFQC[SG]SGRCIPQ[HT]W[VL]CDGLNDCGDGSDE[PS]PA

[HT]C;
and (SEQ ID NO:249)
C[AGPR][AP][DGNS][EQ]F[QRT]C[GSK]N[GT][GHR][R]C

[ILV][PS][ALQ][NST]W[LRV]CDG[DEV]DDC[GL]DGSDE

[AET][DNS][-A][-T]C,
``` wherein amino acids in brackets indicate alternative amino acids at a specified position and "–" indicates no amino acid at the specified position. In specific embodiments the binding protein of claim 1, wherein the binding protein comprises one or more of:

```
                                        (SEQ ID NO: 255)
        CGPDQFRCSSGKCIPQHWLCDGLNDCGDGSDESPATC;

(SEQ ID NO: 256)
        CGANEFQCRSTGICVPVEWVCDGDNDCGDGSDEPPVC;

(SEQ ID NO: 257)
        CGADQFRCGNGSCVPRAWRCDGVDDCGDGSDEAPEIC;

(SEQ ID NO: 258)
        CGPDEFRCNNGQCIPLPWRCDGVDDCGDNSDEPLEIC;

(SEQ ID NO: 259)
        CASGEFTCNNGQCVPLAWRCDGVNDCQDGSDEKGC;

(SEQ ID NO: 260)
        CGPDEFRCNNGQCIPLPWRCDGVDDCGDNSDEPLEIC;

(SEQ ID NO: 261)
        CPPDEFQCRGTKKCLPLAWVCDGDNDCEDDSDEESC;

(SEQ ID NO: 1237)
        CLPDEFQCGSGRCIPQHWLCDGLNDCGDGSDEPPAHC;

(SEQ ID NO: 1326)
        CLPDEFQCGSGRCIPQHWLCDGLNDCGDGSDEPPAHC;
```

```
                                            (SEQ ID NO: 1327)
CAPGEFTCKNTGRCIPLNWRCDGDDDCGDGSDETDC;
and (SEQ ID NO: 1328)
CGPDEFRCNNGQCIPLPWRCDGVDDCGDNSDEPLEIC.
```

A binding protein that selectively binds β-Klotho is provided. In one embodiment the binding protein comprises one or more of:

```
                                            (SEQ ID NO: 394)
CQSNEFRCRSGRCIPQHWLCDGLNDCGDGSDE[PS][PQ][AQ][-H]C;

(SEQ ID NO: 217)
C[ELPQR][APS][DGIN][EGQ][FQ][FKPQRT][-E]C[GNRS]

[NS]G[HNQR]C[IV]P[AELPQRV][AHPQRT]W[LRV]CDG[DEV]

[DNP]DC[GLQ]D[DGNS]SDE[AEKT][DGLNS][-A][-H]C;;
and
                                            (SEQ ID NO: 254)
C[AGP][APS][DGN][EQ]F[QRT]C[GNRS][GNS][GT][GKQS]

[-IK]C[ILV]P[LQRV][AEHP]W[LRV]CDG[DLV][DN]DCGD

[GN]SDE[AEKPS][GLPS][-AEV][-IT]C,
``` wherein amino acids in brackets indicate alternative amino acids at a specified position and "–" indicates no amino acid at the specified position. In specific embodiments the binding protein comprises one or more of:

```
                                            (SEQ ID NO: 159)
CQSNEFRCRSGRCIPQHWLCDGLNDCGDGSDESQQC;

(SEQ ID NO: 1323)
CRAGEFRCSNGRCVPLTWLCDGEDDCQDNSDEKNC;

(SEQ ID NO: 1324)
CPSNQFPCRSTGICIPLAWVCDGLNDCGDGSDESPAHC;
and
                                            (SEQ ID NO: 1325)
CQSNEFRCRSGRCIPQHWLCDGLNDCGDGSDEPPAHC.
```

In another aspect of the present disclosure a binding protein that selectively binds FGFR1c is provided. In one embodiment the binding protein comprises:

```
                                            (SEQ ID NO: 108)
CG[AE][GS]LFTC[GR][NRS][AST][KN]ICIS[EHQS][AV]W

[IV]CDG[IV]DDC[DE]DNSDE[DKMNT][NSY]C,
``` wherein amino acids in brackets indicate alternative amino acids at a specified position and "–" indicates no amino acid at the specified position.
In specific embodiments the binding protein comprises one or more of:

```
                                            (SEQ ID NO: 109)
CGAGLFTCRS TNICISQVWV CDGVDDCEDN SDEDSC;

(SEQ ID NO: 110)
CGAGLFTCRS TNICISQAWV CDGVDDCEDN SDENYC;

(SEQ ID NO: 111)
CGAGLFTCRS TNICISQAWV CDGVDDCEDN SDETNC;

(SEQ ID NO: 112)
CGEGLFTCGS TNICISSAWV CDGVDDCEDN SDENNC;

(SEQ ID NO: 113)
CGEGLFTCRS TNICISHAWV CDGVDDCEDN SDENNC;

(SEQ ID NO: 114)
CGEGLFTCRS TNICISEAWI CDGVDDCEDN SDEKNC;

(SEQ ID NO: 115)
CGAGLFTCRS AKICISHAWV CDGIDDCEDN SDENNC;

(SEQ ID NO: 116)
CGAGLFTCRN SKICISQAWV CDGVDDCDDN SDEKYC;

(SEQ ID NO: 117)
CGASLFTCRR SNICISQAWV CDGVDDCEDN SDEMNC;
and
                                            (SEQ ID NO: 118)
CGAGLFTCRS TKICISQAWV CDGVDDCEDN SDEKNC.
```

The binding protein can further comprise a linker comprising the sequence SAPASEPPGSL (SEQ ID NO: 12).

In yet other specific embodiments the binding protein comprises one or more of:

```
                                            (SEQ ID NO: 293)
CGAGLFTCRSTNICISQVWVCDGVDDCEDNSDEDSCSAPASEPPGSL;

(SEQ ID NO: 294)
CGAGLFTCRSTNICISQAWVCDGVDDCEDNSDENYCSAPASEPPGSL;

(SEQ ID NO: 295)
CGAGLFTCRSTNICISQAWVCDGVDDCEDNSDETNCSAPASEPPGSL;

(SEQ ID NO: 448)
CGEGLFTCGSTNICISSAWVCDGVDDCEDNSDENNCSAPASEPPGSL;

(SEQ ID NO: 297)
CGEGLFTCRSTNICISHAWVCDGVDDCEDNSDENNCSAPASEPPGSL;

(SEQ ID NO: 449)
CGEGLFTCRSTNICISEAWICDGVDDCEDNSDEKNCSAPASEPPGSL;

(SEQ ID NO: 450)
CGAGLFTCRSAKICISHAWVCDGIDDCEDNSDENNCSAPASEPPGSL;

(SEQ ID NO: 464)
CGAGLFTCRNSKICISQAWVCDGVDDCDDNSDEKYCSAPASEPPGSL;

(SEQ ID NO: 296)
CGASLFTCRRSNICISQAWVCDGVDDCEDNSDEMNCSAPASEPPGSL;
and
                                            (SEQ ID NO: 287)
CGAGLFTCRSTKICISQAWVCDGVDDCEDNSDEKNCSAPASEPPGSL.
```

In yet another embodiment the binding protein comprises the sequence:

```
                                            (SEQ ID NO: 297)
CGEGLFTCRSTNICISHAWVCDGVDDCEDNSDENNCSAPASEPPGSL.
```

In a further aspect of the present disclosure a binding protein that selectively binds β-Klotho is provided. In one embodiment the binding protein comprises:

(a) a first β-Klotho binding domain comprising a sequence selected from the group represented by the sequences:

```
                                            (SEQ ID NO: 254)
C[AGP][APS][DGN][EQ]F[QRT]C[GNRS][GNS][GT][GKQS]

[-IK]C[ILV]P[LQRV][AEHP]W[LRV]CDG[DLV][DN]DCGD

[GN]SDE[AEKPS][GLPS][-AEV][-IT]C;
```

```
                                            (SEQ ID NO: 597)
CLPDEFQC[SG]SGRCIPQ[HT]W[VL]CDGLNDCGDGSDE[PS]PA
[HT]C (SEQ ID NO:249)
C[AGPR][AP][DGNS][EQ]F[QRT]C[GSK]N[GT][GHR][-R]C
[ILV][PS][ALQ][NST]W[LRV]CDG[DEV]DDC[GL]DGSDE
[AET][DNS][-A][-T]C;
and
```

(b) a second β-Klotho binding domain comprising a sequence selected from the group represented by the sequences:

```
                                            (SEQ ID NO: 394)
CQSNEFRCRSGRCIPQHWLCDGLNDCGDGSDE[PS][PQ][AQ]
[-H]C;

(SEQ ID NO: 217)
C[ELPQR][APS][DGIN][EGQ][FQ][FKPQRT][-E]C[GNRS]
[NS]G[HNQR]C[IV]P[AELPQRV][AHPQRT]W[LRV]CDG[GLQ]D
[DGNS]SDE[AEKT][DGLNS][-A][-H]C;
and (SEQ ID NO: 254)
C[AGP][APS][DGN][EQ]F[QRT]C[GNRS][GNS][GT][GKQS]
[-IK]C[ILV]P[LQRV][AEHP]W[LRV]CDG[DLV][DN]DCGD
[GN]SDE[AEKPS][GLPS][-AEV][-IT]C,
``` wherein amino acids in brackets indicate alternative amino acids at a specified position and "–" indicates no amino acid at the specified position.

In one embodiment the binding protein further comprises at least one linker joining (a) and (b). The linker can be, for example, one or more of: ETPT (SEQ ID NO: 1319), GDSHILPFSTPGPST (SEQ ID NO: 14), SAPASEPPGSL (SEQ ID NO:12), PAPT (SEQ ID NO:1320), QAPT (SEQ ID NO:1321), AQPT (SEQ ID NO:1322), AHT, PERT (SEQ ID NO: 7), TTRT (SEQ ID NO: 8), GTTGPT (SEQ ID NO: 9), ETSGPT (SEQ ID NO: 10), SQDPEFHKVS (SEQ ID NO: 11), GRPGPGATSAPAA (SEQ ID NO: 13). In other specific embodiments the β-Klotho binding domain of (a) comprises one or more of:

```
                                            (SEQ ID NO: 255)
CGPDQFRCSSGKCIPQHWLCDGLNDCGDGSDESPATC;

(SEQ ID NO: 256)
CGANEFQCRSTGICVPVEWVCDGDNDCGDGSDEPPVC;

(SEQ ID NO: 257)
CGADQFRCGNGSCVPRAWRCDGVDDCGDGSDEAPEIC;

(SEQ ID NO: 258)
CGPDEFRCNNGQCIPLPWRCDGVDDCGDNSDEPLEIC;

(SEQ ID NO: 259)
CASGEFTCNNGQCVPLAWRCDGVNDCQDGSDEKGC;

(SEQ ID NO: 260)
CGPDEFRCNNGQCIPLPWRCDGVDDCGDNSDEPLEIC;

(SEQ ID NO: 261)
CPPDEFQCRGTKKCLPLAWVCDGDNDCEDDSDEESC;

(SEQ ID NO: 1237)
CLPDEFQCGSGRCIPQHWLCDGLNDCGDGSDEPPAHC;

(SEQ ID NO: 1326)
CLPDEFQCGSGRCIPQHWLCDGLNDCGDGSDEPPAHC;

(SEQ ID NO: 1327)
CAPGEFTCKNTGRCIPLNWRCDGDDDCGDGSDETDC;
and
                                            (SEQ ID NO: 1328)
CGPDEFRCNNGQCIPLPWRCDGVDDCGDNSDEPLEIC.
```

In yet other specific embodiments the β-Klotho binding domain of (b) comprises one or more of:

```
                                            (SEQ ID NO: 159)
CQSNEFRCRSGRCIPQHWLCDGLNDCGDGSDESQQC;

(SEQ ID NO: 1323)
CRAGEFRCSNGRCVPLTWLCDGEDDCQDNSDEKNC;

(SEQ ID NO: 1324)
CPSNQFPCRSTGICIPLAWVCDGLNDCGDGSDESPAHC;
and
                                            (SEQ ID NO: 1325)
CQSNEFRCRSGRCIPQHWLCDGLNDCGDGSDEPPAHC.
```

In still another aspect of the present disclosure a binding protein that selectively binds β-Klotho and FGFR1c is provided. In one embodiment the binding protein comprises (a) one or more domains that selectively bind β-Klotho, and (b) one or more domains that selectively bind FGFR1c, wherein the binding protein comprises:

(a) a β-Klotho binding domain comprising one or more of:

```
                                            (SEQ ID NO: 254)
C[AGP][APS][DGN][EQ]F[QRT]C[GNRS][GNS][GT][GKQS]
[-IK]C[ILV]P[LQRV][AEHP]W[LRV]CDG[DLV][DN]DCGD
[GN]SDE[AEKPS][GLPS][-AEV][-IT]C;

(SEQ ID NO: 597)
CLPDEFQC[SG]SGRCIPQ[HT]W[VL]CDGLNDCGDGSDE[PS]PA
[HT]C;

(SEQ ID NO: 249)
C[AGPR][AP][DGNS][EQ]F[QRT]C[GSK]N[GT][GHR][-R]C
[ILV][PS][ALQ][NST]W[LRV]CDG[DEV]DDC[GL]DGSDE[AE
T][DNS][-A][-T]C;
```

(b) an FGFR1c binding domain comprising one or more of:

```
                                            (SEQ ID NO: 108)
CG[AE][GS]LFTC[GR][NRS][AST][KN]ICIS[EHQS][AV]W
[IV]CDG[IV]DDC[DE]DNSDE[DKMNT][NSY]C;
and
``` wherein amino acids in brackets indicate alternative amino acids at a specified position and "–" indicates no amino acid at the specified position. The binding protein can further comprise at least one linker joining (a) and (b). In specific embodiments the linker is one or more of: ETPT (SEQ ID NO: 1319), GDSHILPFSTPGPST (SEQ ID NO: 14), SAPASEPPGSL (SEQ ID NO:12), PAPT (SEQ ID NO:1320), QAPT (SEQ ID NO:1321), AQPT (SEQ ID NO:1322), AHT, PERT (SEQ ID NO: 7), TTRT (SEQ ID NO: 8), GTTGPT (SEQ ID NO: 9), ETSGPT (SEQ ID NO: 10), SQDPEFHKVS (SEQ ID NO: 11), GRPGPGATSAPAA (SEQ ID NO: 13). In other specific embodiments (i) the β-Klotho binding domain of (a) comprises one or more of:

CGPDQFRCSSGKCIPQHWLCDGLNDCGDGSDESPATC; (SEQ ID NO: 255)

CGANEFQCRSTGICVPVEWVCDGDNDCGDGSDEPPVC; (SEQ ID NO: 256)

CGADQFRCGNGSCVPRAWRCDGVDDCGDGSDEAPEIC; (SEQ ID NO: 257)

CGPDEFRCNNGQCIPLPWRCDGVDDCGDNSDEPLEIC; (SEQ ID NO: 258)

CASGEFTCNNGQCVPLAWRCDGVNDCQDGSDEKGC; (SEQ ID NO: 259)

CGPDEFRCNNGQCIPLPWRCDGVDDCGDNSDEPLEIC; (SEQ ID NO: 260)

CPPDEFQCRGTKKCLPLAWVCDGDNDCEDDSDEESC; (SEQ ID NO: 261)

CLPDEFQCGSGRCIPQHWLCDGLNDCGDGSDEPPAHC; (SEQ ID NO: 1237)

CLPDEFQCGSGRCIPQHWLCDGLNDCGDGSDEPPAHC; (SEQ ID NO: 1326)

CAPGEFTCKNTGRCIPLNWRCDGDDDCGDGSDETDC; and (SEQ ID NO: 1327)

CGPDEFRCNNGQCIPLPWRCDGVDDCGDNSDEPLEIC; and (SEQ ID NO: 1328)

(ii) the FGFR1c binding domain of (b) comprises one or more of:

CGAGLFTCRS TNICISQVWV CDGVDDCEDN SDEDSC; (SEQ ID NO: 109)

CGAGLFTCRS TNICISQAWV CDGVDDCEDN SDENYC; (SEQ ID NO: 110)

CGAGLFTCRS TNICISQAWV CDGVDDCEDN SDETNC; (SEQ ID NO: 111)

CGEGLFTCGS TNICISSAWV CDGVDDCEDN SDENNC; (SEQ ID NO: 112)

CGEGLFTCRS TNICISHAWV CDGVDDCEDN SDENNC; (SEQ ID NO: 113)

CGEGLFTCRS TNICISEAWI CDGVDDCEDN SDEKNC; (SEQ ID NO: 114)

CGAGLFTCRS AKICISHAWV CDGIDDCEDN SDENNC; (SEQ ID NO: 115)

CGAGLFTCRN SKICISQAWV CDGVDDCDDN SDEKYC; (SEQ ID NO: 116)

CGASLFTCRR SNICISQAWV CDGVDDCEDN SDEMNC; and (SEQ ID NO: 117)

CGAGLFTCRS TKICISQAWV CDGVDDCEDN SDEKNC. (SEQ ID NO: 118)

In still other specific embodiments the FGFR1c binding domain of (b) further comprises a linker comprising the sequence SAPASEPPGSL (SEQ ID NO: 12). In yet other specific embodiments the FGFR1c binding domain comprises one or more of:

CGAGLFTCRSTNICISQVWVCDGVDDCEDNSDEDSCSAPASEPPGSL; (SEQ ID NO: 293)

CGAGLFTCRSTNICISQAWVCDGVDDCEDNSDENYCSAPASEPPGSL; (SEQ ID NO: 294)

CGAGLFTCRSTNICISQAWVCDGVDDCEDNSDETNCSAPASEPPGSL; (SEQ ID NO: 295)

CGEGLFTCGSTNICISSAWVCDGVDDCEDNSDENNCSAPASEPPGSL; (SEQ ID NO: 448)

CGEGLFTCRSTNICISHAWVCDGVDDCEDNSDENNCSAPASEPPGSL; (SEQ ID NO: 297)

CGEGLFTCRSTNICISEAWICDGVDDCEDNSDEKNCSAPASEPPGSL; (SEQ ID NO: 449)

CGAGLFTCRSAKICISHAWVCDGIDDCEDNSDENNCSAPASEPPGSL; (SEQ ID NO: 450)

CGAGLFTCRNSKICISQAWVCDGVDDCDDNSDEKYCSAPASEPPGSL; (SEQ ID NO: 464)

CGASLFTCRRSNICISQAWVCDGVDDCEDNSDEMNCSAPASEPPGSL; and (SEQ ID NO: 296)

CGAGLFTCRSTKICISQAWVCDGVDDCEDNSDEKNCSAPASEPPGSL. (SEQ ID NO: 287)

In still another aspect of the present disclosure a binding protein that selectively binds β-Klotho and FGFR1c comprising (a) one or more domains that selectively bind β-Klotho, and (b) one or more domains that selectively bind FGFR1c is provided. In one embodiment the binding protein comprises:
(a) a β-Klotho binding domain comprising one or more of:

CQSNEFRCRSGRCIPQHWLCDGLNDCGDGSDE[PS][PQ][AQ][-H]C; (SEQ ID NO: 394)

C[ELPQR][APS][DGIN][EGQ][FQ][FKPQRT][-E]C[GNRS][NS]G[HNQR]C[IV]P[AELPQRV][AHPQRT]W[LRV]CDG[DEV][DNP]DC[GLQ]D[DGNS]SDE[AEKT][DGLNS][-A][-H]C; (SEQ ID NO: 217)

C[AGP][APS][DGN][EQ]F[QRT]C[GNRS][GNS][GT][GKQS][-IK]C[ILV]P[LQRV][AEHP]W[LRV]CDG[DLV][DN]DCGD[GN]SDE[AEKPS][GLPS][-AEV][-IT]C; (SEQ ID NO: 254)

and
(b) an FGFR1c binding domain comprising a sequence selected from the group represented by the sequence:

CG[AE][GS]LFTC[GR][N][NRS][AST][KN]ICIS[EHQS][AV]W[IV]CDG[IV]DDC[DE]DNSDE[DKMNT][NSY]C; (SEQ ID NO: 108)

wherein amino acids in brackets indicate alternative amino acids at a specified position and "–" indicates no amino acid at the specified position. The binding protein can further comprises at least one linker joining (a) and (b). In specific embodiments the linker is one or more of: ETPT (SEQ ID NO: 1319), GDSHILPFSTPGPST (SEQ ID NO: 14), SAPASEPPGSL (SEQ ID NO:12), PAPT (SEQ ID NO:1320), QAPT (SEQ ID NO:1321), AQPT (SEQ ID NO:1322), AHT, PERT (SEQ ID NO: 7), TTRT (SEQ ID NO: 8), GTTGPT (SEQ ID NO: 9), ETSGPT (SEQ ID NO: 10), SQDPEFHKVS (SEQ ID NO: 11), GRPGPGATSAPAA (SEQ ID NO: 13). In particular embodiments
(i) the β-Klotho binding domain of (a) comprises one or more of:

```
                                        (SEQ ID NO: 159)
CQSNEFRCRSGRCIPQHWLCDGLNDCGDGSDESQQC;

(SEQ ID NO: 1323)
CRAGEFRCSNGRCVPLTWLCDGEDDCQDNSDEKNC;

(SEQ ID NO: 1324)
CPSNQFPCRSTGICIPLAWVCDGLNDCGDGSDESPAHC;
and (SEQ ID NO: 1325)
CQSNEFRCRSGRCIPQHWLCDGLNDCGDGSDEPPAHC;
and
```

(ii) the FGFR1c binding domain of (b) comprises one or more of:

```
                                        (SEQ ID NO: 109)
CGAGLFTCRS TNICISQVWV CDGVDDCEDN SDEDSC;

(SEQ ID NO: 110)
CGAGLFTCRS TNICISQAWV CDGVDDCEDN SDENYC;

(SEQ ID NO: 111)
CGAGLFTCRS TNICISQAWV CDGVDDCEDN SDETNC;

(SEQ ID NO: 112)
CGEGLFTCGS TNICISSAWV CDGVDDCEDN SDENNC;

(SEQ ID NO: 113)
CGEGLFTCRS TNICISHAWV CDGVDDCEDN SDENNC;

(SEQ ID NO: 114)
CGEGLFTCRS TNICISEAWI CDGVDDCEDN SDEKNC;

(SEQ ID NO: 115)
CGAGLFTCRS AKICISHAWV CDGIDDCEDN SDENNC;

(SEQ ID NO: 116)
CGAGLFTCRN SKICISQAWV CDGVDDCDDN SDEKYC;

(SEQ ID NO: 117)
CGASLFTCRR SNICISQAWV CDGVDDCEDN SDEMNC;
and (SEQ ID NO: 118)
CGAGLFTCRS TKICISQAWV CDGVDDCEDN SDEKNC.
```

The FGFR1c binding domain of (b) can further comprise a linker; in one embodiment the linker comprises the sequence SAPASEPPGSL (SEQ ID NO: 12). In particular embodiments the FGFR1c binding domain comprises one or more of:

```
                                        (SEQ ID NO: 293)
CGAGLFTCRSTNICISQVWVCDGVDDCEDNSDEDSCSAPASEPPGSL;

(SEQ ID NO: 294)
CGAGLFTCRSTNICISQAWVCDGVDDCEDNSDENYCSAPASEPPGSL;

(SEQ ID NO: 295)
CGAGLFTCRSTNICISQAWVCDGVDDCEDNSDETNCSAPASEPPGSL;

(SEQ ID NO: 448)
CGEGLFTCGSTNICISSAWVCDGVDDCEDNSDENNCSAPASEPPGSL;

(SEQ ID NO: 297)
CGEGLFTCRSTNICISHAWVCDGVDDCEDNSDENNCSAPASEPPGSL;

(SEQ ID NO: 449)
CGEGLFTCRSTNICISEAWICDGVDDCEDNSDEKNCSAPASEPPGSL;

(SEQ ID NO: 450)
CGAGLFTCRSAKICISHAWVCDGIDDCEDNSDENNCSAPASEPPGSL;

(SEQ ID NO: 464)
CGAGLFTCRNSKICISQAWVCDGVDDCDDNSDEKYCSAPASEPPGSL;

(SEQ ID NO: 296)
CGASLFTCRRSNICISQAWVCDGVDDCEDNSDEMNCSAPASEPPGSL;
and (SEQ ID NO: 287)
CGAGLFTCRSTKICISQAWVCDGVDDCEDNSDEKNCSAPASEPPGSL.
```

In still another aspect a binding protein that selectively binds β-Klotho and FGFR1c comprising (a) one or more domains that selectively bind β-Klotho, and (b) one or more domains that selectively bind FGFR1c is provided. In one embodiment the binding protein comprises:

(a) a β-Klotho binding domain comprising:
(i) a first binding domain comprising one or more of:

```
                                        (SEQ ID NO: 254)
C[AGP][APS][DGN][EQ]F[QRT]C[GNRS][GNS][GT][GKQS]
[-IK]C[ILV]P[LQRV][AEHP]W[LRV]CDG[DLV][DN]DCGD
[GN]SDE[AEKPS][GLPS][-AEV][-IT]C;

(SEQ ID NO: 597)
CLPDEFQC[SG]SGRCIPQ[HT]W[VL]CDGLNDCGDGSDE[PS]PA[H
T]C;

(SEQ ID NO: 249)
C[AGPR][AP][DHNS][EQ]F[QRT]C[GSK]N[GT][GHR][-R]C
[ILV][PS][ALQ][NST]W[LRV]CDG[DEV]DDC[GL]DGSDE
[AET][DNS][-A][-T]C;
```

(ii) a second binding domain comprising one or more of:

```
                                        (SEQ ID NO: 394)
CQSNEFRCRSGRCIPQHWLCDGLNDCGDGSDE[PS][PQ][AQ][-H]
C;

(SEQ ID NO: 217)
C[ELPQR][APS][DGIN][EGQ][FQ][FKPQRT][-E]C[GNRS]
[NS]G[HNQR]C[IV]P[AELPQRV][AHPQRT]W[LRV]CDG[DEV]
[DNP]DC[GLQ]D[DGNS]SDE[AEKT][DGLNS][-A][-H]C;

(SEQ ID NO: 254)
C[AGP][APS][DGN][EQ]F[QRT]C[GNRS][GNS][GT][GKQS]
[-K]C[ILV]P[LQRV][AEHP]W[LRV]CDG[DLV][DN]DCGD[GN]
SDE[AEKSPS][GLPS][-AEV][-IT]C;
```
and
(iii) a linker joining the first binding domain and the second binding domain; and (b) an FGFR1c binding domain comprising a sequence selected from the group represented by the sequence:

```
                                        (SEQ ID NO: 108)
CG[AE][GS]LFTC[GR][NRS][AST][KN]ICIS[EHQS][AV]W
[IV]CDG[IV]DDC[DE]DNSDE[DKMNT][NSY]C;
and
```

(c) a linker joining the sequences of (a) and (b),
wherein amino acids in brackets indicate alternative amino acids at a specified position and "–" indicates no amino acid at the specified position. In particular embodiments the first binding domain of (a) comprises one or more of:

```
                                        (SEQ ID NO: 255)
CGPDQFRCSSGKCIPQHWLCDGLNDCGDGSDESPATC;

(SEQ ID NO: 256)
CGANEFQCRSTGICVPVEWVCDGDNDCGDGSDEPPVC;

(SEQ ID NO: 257)
CGADQFRCGNGSCVPRAWRCDGVDDCGDGSDEAPEIC;
```

CGPDEFRCNNGQCIPLPWRCDGVDDCGDNSDEPLEIC; (SEQ ID NO: 258)

CASGEFTCNNGQCVPLAWRCDGVNDCQDGSDEKGC; (SEQ ID NO: 259)

CGPDEFRCNNGQCIPLPWRCDGVDDCGDNSDEPLEIC; (SEQ ID NO: 260)

CPPDEFQCRGTKKCLPLAWVCDGDNDCEDDSDEESC; (SEQ ID NO: 261)

CLPDEFQCGSGRCIPQHWLCDGLNDCGDGSDEPPAHC; (SEQ ID NO: 1237)

CLPDEFQCGSGRCIPQHWLCDGLNDCGDGSDEPPAHC; (SEQ ID NO: 1326)

CAPGEFTCKNTGRCIPLNWRCDGDDDCGDGSDETDC; (SEQ ID NO: 1327)
and

CGPDEFRCNNGQCIPLPWRCDGVDDCGDNSDEPLEIC. (SEQ ID NO: 1328)

In other particular embodiments the second binding domain of (a) comprises one or more of:

CQSNEFRCRSGRCIPQHWLCDGLNDCGDGSDESQQC; (SEQ ID NO: 159)

CRAGEFRCSNGRCVPLTWLCDGEDDCQDNSDEKNC (SEQ ID NO: 1323)

CPSNQFPCRSTGICIPLAWVCDGLNDCGDGSDESPAHC; (SEQ ID NO: 1324)
and

CQSNEFRCRSGRCIPQHWLCDGLNDCGDGSDEPPAHC. (SEQ ID NO: 1325)

In yet other embodiments the linker of (a) comprises one or more of: ETPT (SEQ ID NO: 1319), GDSHILPFSTPGPST (SEQ ID NO: 14), SAPASEPPGSL (SEQ ID NO:12), PAPT (SEQ ID NO:1320) and QAPT (SEQ ID NO:1321). In still further embodiments the FGFR1c binding domain comprises one or more of:

CGAGLFTCRS TNICISQVWV CDGVDDCEDN SDEDSC; (SEQ ID NO: 109)

CGAGLFTCRS TNICISQAWV CDGVDDCEDN SDENYC; (SEQ ID NO: 110)

CGAGLFTCRS TNICISQAWV CDGVDDCEDN SDETNC; (SEQ ID NO: 111)

CGEGLFTCGS TNICISSAWV CDGVDDCEDN SDENNC; (SEQ ID NO: 112)

CGEGLFTCRS TNICISHAWV CDGVDDCEDN SDENNC; (SEQ ID NO: 113)

CGEGLFTCRS TNICISEAWI CDGVDDCEDN SDEKNC; (SEQ ID NO: 114)

CGAGLFTCRS AKICISHAWV CDGIDDCEDN SDENNC; (SEQ ID NO: 115)

CGAGLFTCRN SKICISQAWV CDGVDDCDDN SDEKYC; (SEQ ID NO: 116)

CGASLFTCRR SNICISQAWV CDGVDDCEDN SDEMNC; (SEQ ID NO: 117)
and

CGAGLFTCRS TKICISQAWV CDGVDDCEDN SDEKNC. (SEQ ID NO: 118)

The FGFR1c binding domain can further comprise a linker comprising the sequence SAPASEPPGSL (SEQ ID NO: 12) and, in specific embodiments can comprise one or more of:

CGAGLFTCRSTNICISQVWVCDGVDDCEDNSDEDSCSAPASEPPGSL; (SEQ ID NO: 293)

CGAGLFTCRSTNICISQAWVCDGVDDCEDNSDENYCSAPASEPPGSL; (SEQ ID NO: 294)

CGAGLFTCRSTNICISQAWVCDGVDDCEDNSDETNCSAPASEPPGSL; (SEQ ID NO: 295)

CGEGLFTCGSTNICISSAWVCDGVDDCEDNSDENNCSAPASEPPGSL; (SEQ ID NO: 448)

CGEGLFTCRSTNICISHAWVCDGVDDCEDNSDENNCSAPASEPPGSL; (SEQ ID NO: 297)

CGEGLFTCRSTNICISEAWICDGVDDCEDNSDEKNCSAPASEPPGSL; (SEQ ID NO: 449)

CGAGLFTCRSAKICISHAWVCDGIDDCEDNSDENNCSAPASEPPGSL; (SEQ ID NO: 450)

CGAGLFTCRNSKICISQAWVCDGVDDCDDNSDEKYCSAPASEPPGSL; (SEQ ID NO: 464)

CGASLFTCRRSNICISQAWVCDGVDDCEDNSDEMNCSAPASEPPGSL; (SEQ ID NO: 296)
and

CGAGLFTCRSTKICISQAWVCDGVDDCEDNSDEKNCSAPASEPPGSL. (SEQ ID NO: 287)

For example, the FGFR1c binding domain can comprise one or more of: CGEGLFTCRSTNICISHAWVCDGVD-DCEDNSDENNCSAPASEPPGSL (SEQ ID NO: 297). In still further embodiments the linker of (c) can comprise one or more of: AQPT (SEQ ID NO:1322), AHT, PERT (SEQ ID NO: 7), TTRT (SEQ ID NO: 8), GTTGPT (SEQ ID NO: 9), ETSGPT (SEQ ID NO: 10), SQDPEFHKVS (SEQ ID NO: 11), SAPASEPPGSL (SEQ ID NO: 12), GRPGPGATSA-PAA (SEQ ID NO: 13), and GDSHILPFSTPGPST (SEQ ID NO: 14). In one particular embodiment the binding protein comprises the sequence: CGADQFRCGNG-SCVPRAWRCDGVDDCGDGSDEAPEICE-TPTCQSNEFRCRSGRCIPQ HWLCDGLNDCGDGS-DESQQCSAPASEPPGSLCGEGLFTCRSTNICISHAWV-CDGVDD CEDNSDENNCSAPASEPPGSL (SEQ ID NO: 359). In another particular embodiment the binding protein comprises the sequence: CLPDEFQCGSGRCIPQHWL-CDGLNDCGDGSDE PPAHCSAPASEPPGSLCRAGE-FRCSNGRCVPLTWLCDGEDDCQDNSDE-KNCAQPTCG EGLFTCRSTNICISHAWVCDGVD-DCEDNSDENNCSAPASEPPGSL (SEQ ID NO:339). In yet another particular embodiment the binding protein comprises the sequence: CAPGEFTCKNTGRCIPLNWRCDGD-DDCGDGSDETDCPAPTCPSNQFPCRSTGICIPLA WVCDGLNDCGDGSDESPAHCSAPASEP-PGSLCGEGLFTCRSTNICISHAWVCDGVDD CEDNS-DENNCSAPASEPPGSL (SEQ ID NO:1270). In still a further particular embodiment the binding protein comprises the sequence: CGPDEFRCNNGQCIPLP WRCDGVD-DCGDNSDEPLEICQAPTCQSNEFRCRS-GRCIPQHWLCDGLNDCGDGSDE PPAHCSAPASEP-

PGSLCGEGLFTCRSTNICISHAWVCDGVDDCEDNSD-ENNCSAPASE PPGSL (SEQ ID NO:1271).

In another aspect a binding protein is provided that comprises:

$$(B1)_a\text{-}(L1)_x\text{-}(B2)_b\text{-}(L2)_y\text{-}(1C)_c\text{-}(L3)_z$$

wherein a, b, c, x, y, and z is 0, 1, or 2, provided however that at least one of a, b, and c is 1 or 2; wherein B1 is an amino acid sequence comprising one or more of: C[AGP][APS][DGN][EQ]F[QRT]C[GNRS][GNS][GT][GKQS][-IK]C[ILV]P[LQRV][AEHP]W[LRV]CDG[DLV][DN]DCGD[GN]SDE[AEKPS][GLPS][-AEV][-IT]C (SEQ ID NO: 254); CLPDEFQC[SG]SGRCIPQ[HT]W[VL]CDGLND-CGD GSDE[PS]PA[HT]C (SEQ ID NO: 597); and C[AGPR][AP][DGNS][EQ]F[QRT]C[GSK]N[GT][GHR][R]C[ILV][PS][ALQ][NST]W[LRV]CDG[DEV]DDC[GL]DGSDE[AE T][DNS][-A][-T]C (SEQ ID NO:249); wherein B2 is an amino acid sequence comprising one or more of: CQSNEFR-CRSGRCIPQHWLCDGLNDCGDGSDE[PS][PQ][AQ][-H]C (SEQ ID NO: 394); C[ELPQR][APS][DGIN][EGQ][FQ][FKPQRT][-E]C[GNRS][NS]G[HNQR]C[IV]P[AELPQRV][AHPQRT]W[LRV]CDG[DEV][DNP]DC[GLQ]D[DGNS]SD E[AEKT][DGLNS][-A][-H]C (SEQ ID NO: 217); and C[AGP][APS][DGN][EQ]F[QRT]C[GNRS][GNS][GT][GKQS][-IK]C[ILV]P[LQRV][AEHP]W[LRV]CDG[DLV][DN]DCGD[GN]SDE[AEKPS][GLPS][-AEV][-IT]C (SEQ ID NO: 254); wherein amino acids in brackets indicate alternative amino acids at a specified position and "–" indicates no amino acid at the specified position; wherein 1C is an amino acid sequence comprising CG[AE][GS]LFTC[GR][NRS][AST][KN]ICIS [EHQS][AV]W[IV]CDG[IV]DDC[DE]DNSDE[DKMNT][NSY]C (SEQ ID NO: 108); wherein amino acids in brackets indicate alternative amino acids at a specified position and "–" indicates no amino acid at the specified position; wherein L1 is an amino acid sequence comprising one or more of: ETPT (SEQ ID NO: 1319), GDSHILPFSTPGPST (SEQ ID NO: 14), SAPASEPPGSL (SEQ ID NO:12), PAPT (SEQ ID NO:1320) and QAPT (SEQ ID NO:1321); wherein L2 is an amino acid sequence comprising one or more of: AQPT (SEQ ID NO:1322), AHT, PERT (SEQ ID NO: 7), TTRT (SEQ ID NO: 8), GTTGPT (SEQ ID NO: 9), ETSGPT (SEQ ID NO: 10), SQDPEFHKVS (SEQ ID NO: 11), SAPASEPPGSL (SEQ ID NO: 12), GRPGPGATSAPAA (SEQ ID NO: 13), and GDSHILPFSTPGPST (SEQ ID NO: 14); and wherein L3 is SAPASEPPGSL.

In a further aspect, the binding proteins provided herein can further comprise a half life-extending moiety that increases the serum half-life of the binding protein in a mammal compared to the serum half-life of the binding protein lacking the half life-extending moiety in a mammal For example, the half life-extending moiety is one or more of: polyethylene glycol (PEG), human serum albumin (HSA), an immunoglobulin (IgG), and an Fc moiety. The half life-extending moiety can also comprise a protein sequence that specifically binds a blood factor, such as serum albumin, an immunoglobulin or an erythrocyte.

In another aspect the binding protein can comprise an amino acid sequence comprising one or more non-naturally occurring amino acids.

Also provided is a polynucleotide encoding a binding protein comprising, in various embodiments, one or more of: (a) a β-Klotho binding domain; (b) an FGFR1c binding domain; (c) one or more β-Klotho binding domains and an FGFR1c binding domain; and (c) a binding protein comprising the amino acid sequence CGADQFRCGNGSCVPR AWRCDGVDDCGDGSDEAPEICETPTCQS-NEFRCRSGRCIPQHWLCDGLNDCGDGSD ESQQCSA-PASEPPGSLCGEGLFTCRSTNI-CISHAWVCDGVDDCEDNSDENNCSAPASE PPGSL (SEQ ID NO: 359); CLPDEFQCGSGRCIPQHWLCDG-LNDCGDGSDEPP AHCSAPASEPPGSLCRAGEFRCSN-GRCVPLTWLCDGEDDCQDNSDEKNCAQPTCGE GLFTCRSTNICISHAWVCDGVDDCEDNS-DENNCSAPASEPPGSL (SEQ ID NO:339); CAPGEFTCKNTGRCIPLNWRCDGD-DDCGDGSDETDCPAPTCPSNQFPCRSTGICIPLA WVCDGLNDCGDGSDESPAHCSAPASEP-PGSLCGEGLFTCRSTNICISHAWVCDGVDD CEDNS-DENNCSAPASEPPGSL (SEQ ID NO:1270); or CGPDE-FRCNNGQCIPLP WRCDGVDDCGDNSDEPLEICQAPTCQS-NEFRCRSGRCIPQHWLCDGLNDCGDGSDE PPAHC-SAPASEPPGSLCGEGLFTCRSTNI-CISHAWVCDGVDDCEDNSDENNCSAPASE PPGSL (SEQ ID NO:1271). The encoded binding proteins can also comprise a half-life extending moiety. Also provided are an expression vector comprising any of the provided polynucleotides, as well as host cells comprising the expression vector. A method of making a binding protein is also provided and comprises incubating the disclosed host cells under conditions suitable to induce expression of the binding protein, and optionally isolating the expressed polypeptide.

In another aspect, a pharmaceutical composition is provided and in particular embodiments comprises: (a) a binding protein provided herein; and (b) a pharmaceutically acceptable formulation agent. The pharmaceutically acceptable formulation agent can be a carrier, adjuvant, solubilizer, stabilizer, or anti-oxidant.

In still a further aspect a method for treating a metabolic disorder is provided. The method comprises administering to a human patient in need thereof the disclosed pharmaceutical compositions. The metabolic disorder can be, for example, one or more of: diabetes, obesity, dyslipidimia, hypertension, hepatosteaotosis, non-alcoholic steatohepatitis (NASH), acute pancreatitis, metabolic syndrome, cardiovascular disease, such as atherosclerosis, and aging. In a specific embodiment the metabolic disorder is diabetes, and in another specific embodiment the metabolic disorder is obesity.

In one aspect the present disclosure provides binding proteins, monomers and multimers comprising amino acid sequences that are at least 80%, 85%, 90%, 91%, 92%, 93%, 94%, 95%, 96%, 97%, 98%, or 99% identical to the amino acid sequences of the binding proteins, monomers and multimers disclosed herein.

In another aspect, the binding proteins, monomers and multimers disclosed herein are recombinant, and thus are not found in nature. Such binding proteins, monomers and multimers are engineered as described herein.

BRIEF DESCRIPTION OF THE DRAWINGS

FIG. 2 is an alignment of partial amino acid sequence from a variety of the LDL-receptor class A-domains (SEQ ID NOS 768-780, respectively, in order of appearance) to demonstrate the conserved cysteines. The connectivity of cysteines in the three disulfide bonds of the folded domain is illustrated schematically on the consensus sequence. Residues whose sidechains contribute to calcium binding are designated with an asterisk in the consensus sequence.

FIG. 3, panel A is a sequence schematically illustrating an example of an A-domain. Panel A schematically illustrates conserved amino acids in an A-domain of about 40 amino acids long. The conserved cysteine residues are indicated by C, and the conserved negatively charged amino acids are indicated by a circle with a minus ("−") sign. Circles with an "H" indicate conserved hydrophobic residues. Panel B is a cartoon schematically illustrating two folded A-domains connected via a linker. Panel B also highlights two calcium binding sites, dark circles with $Ca^{+2}$, and three disulfide bonds within each folded A-domain for a total of 6 disulfide bonds.

FIG. 4 is a list highlighting some of the ligands recognized by naturally-occurring members of the LDL-receptor family, which include inhibitors, proteases, protease complexes, vitamin-carrier complexes, proteins involved in lipoprotein metabolism, non-human ligands, antibiotics, viruses, and others.

Figure 5A:
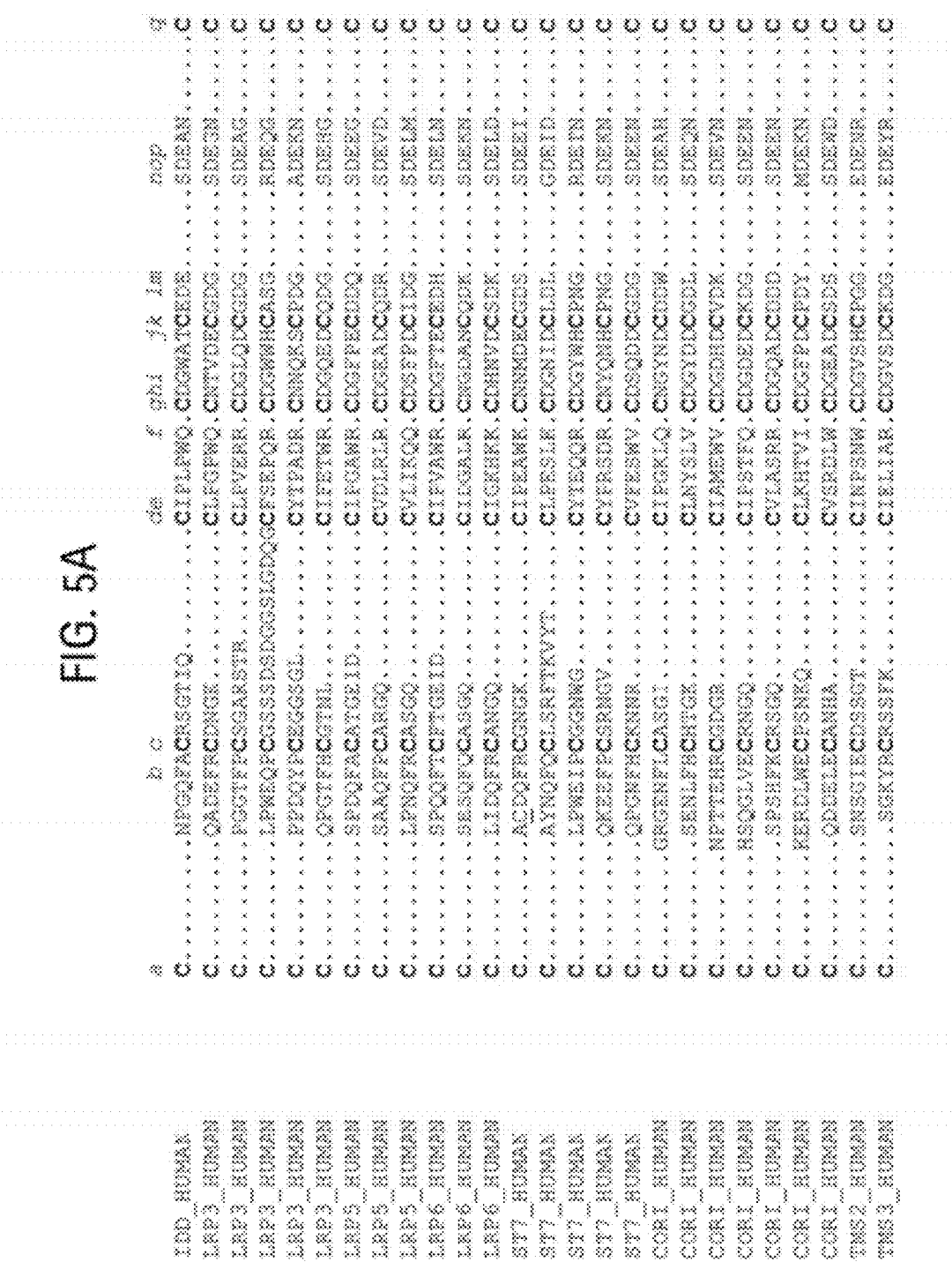
Figure 5B:
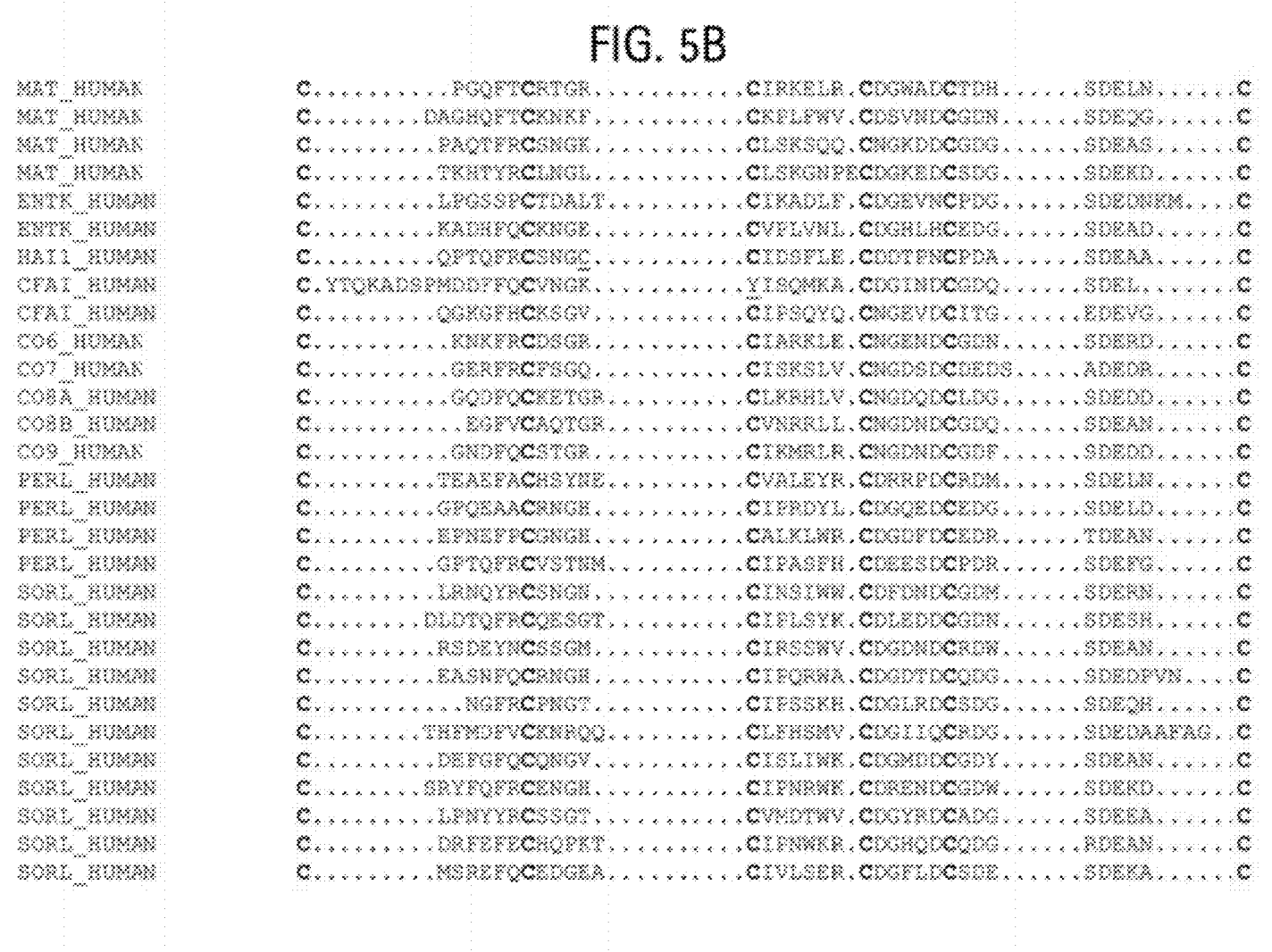
Figure 5C:
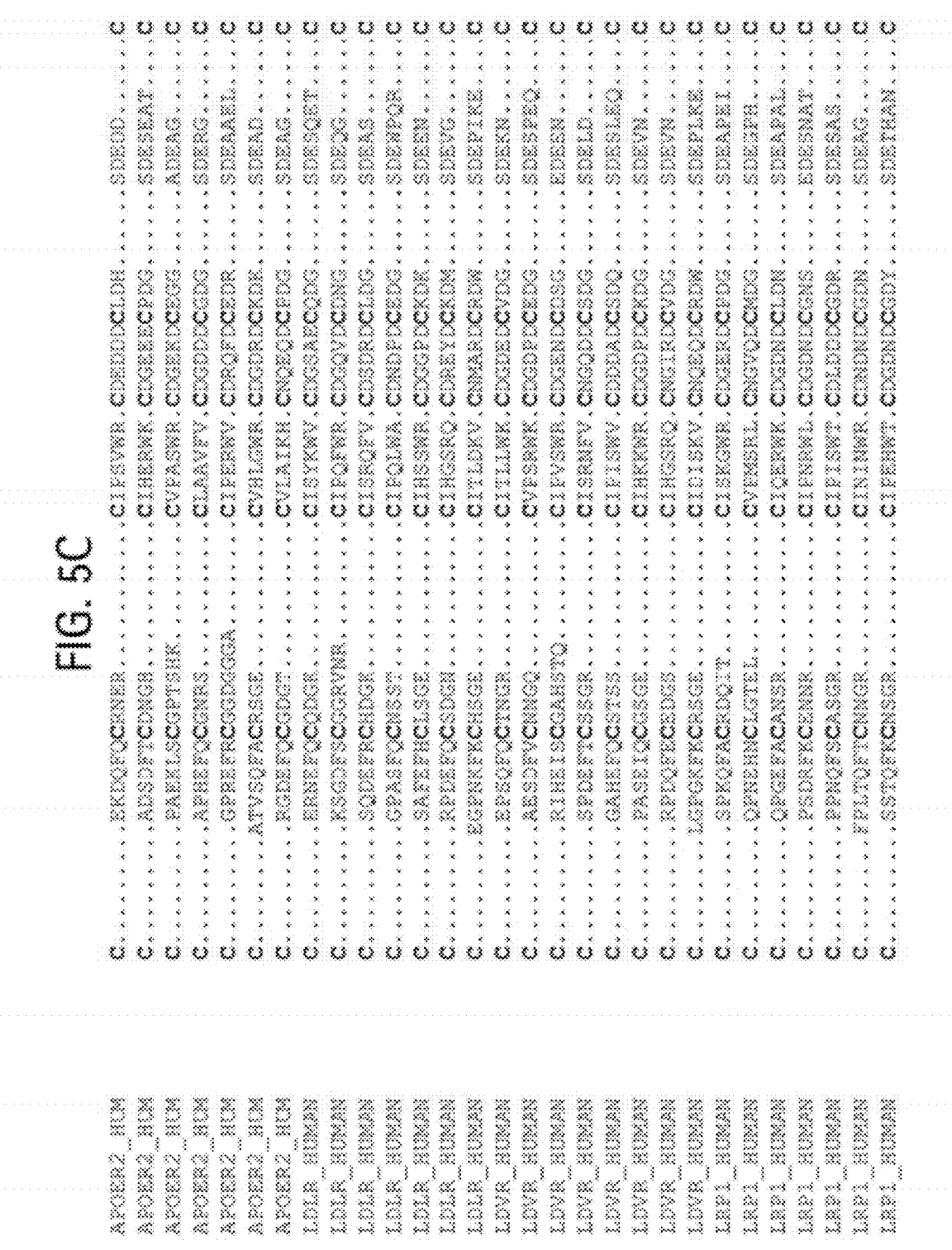
Figure 5D:
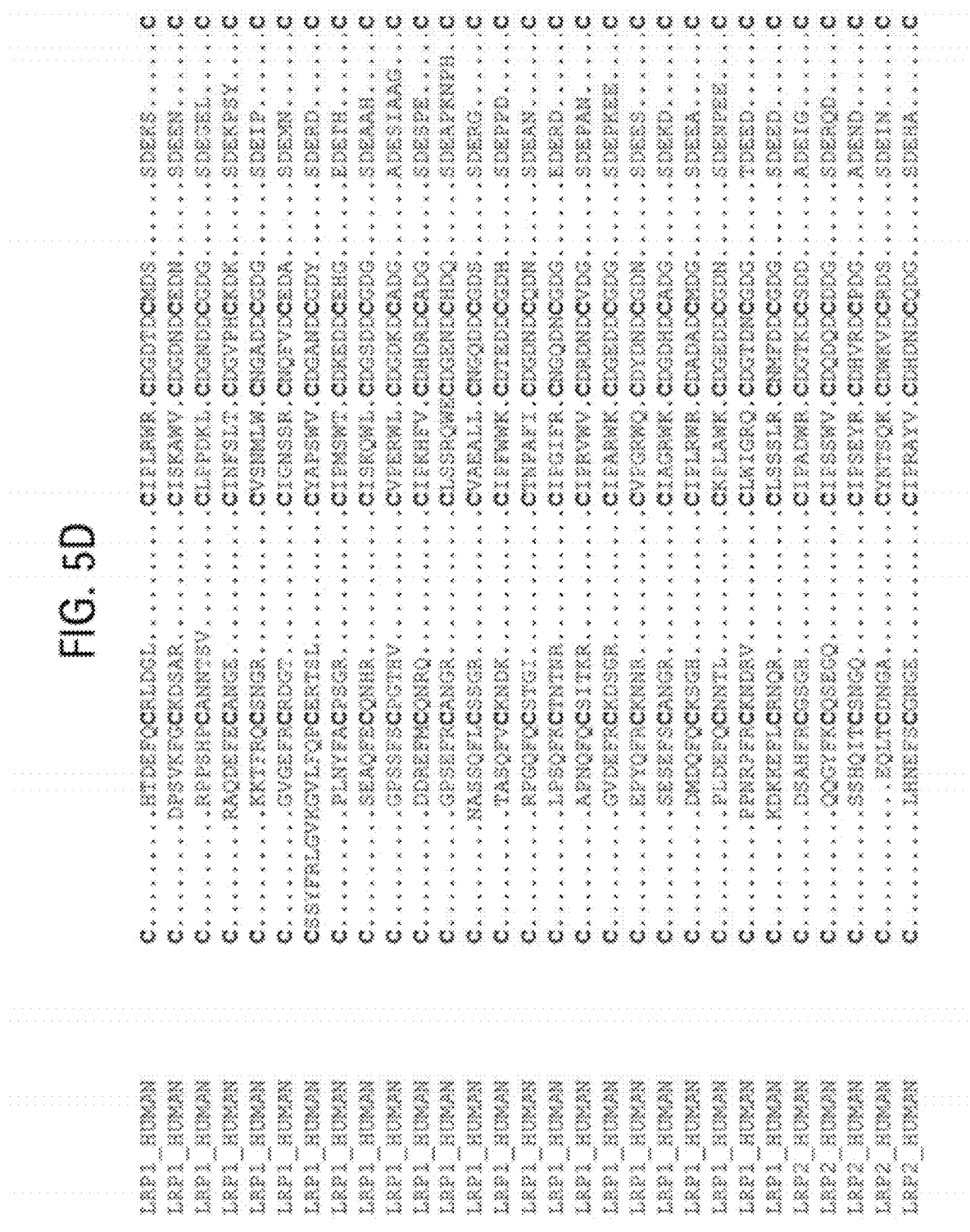
Figure 5E:
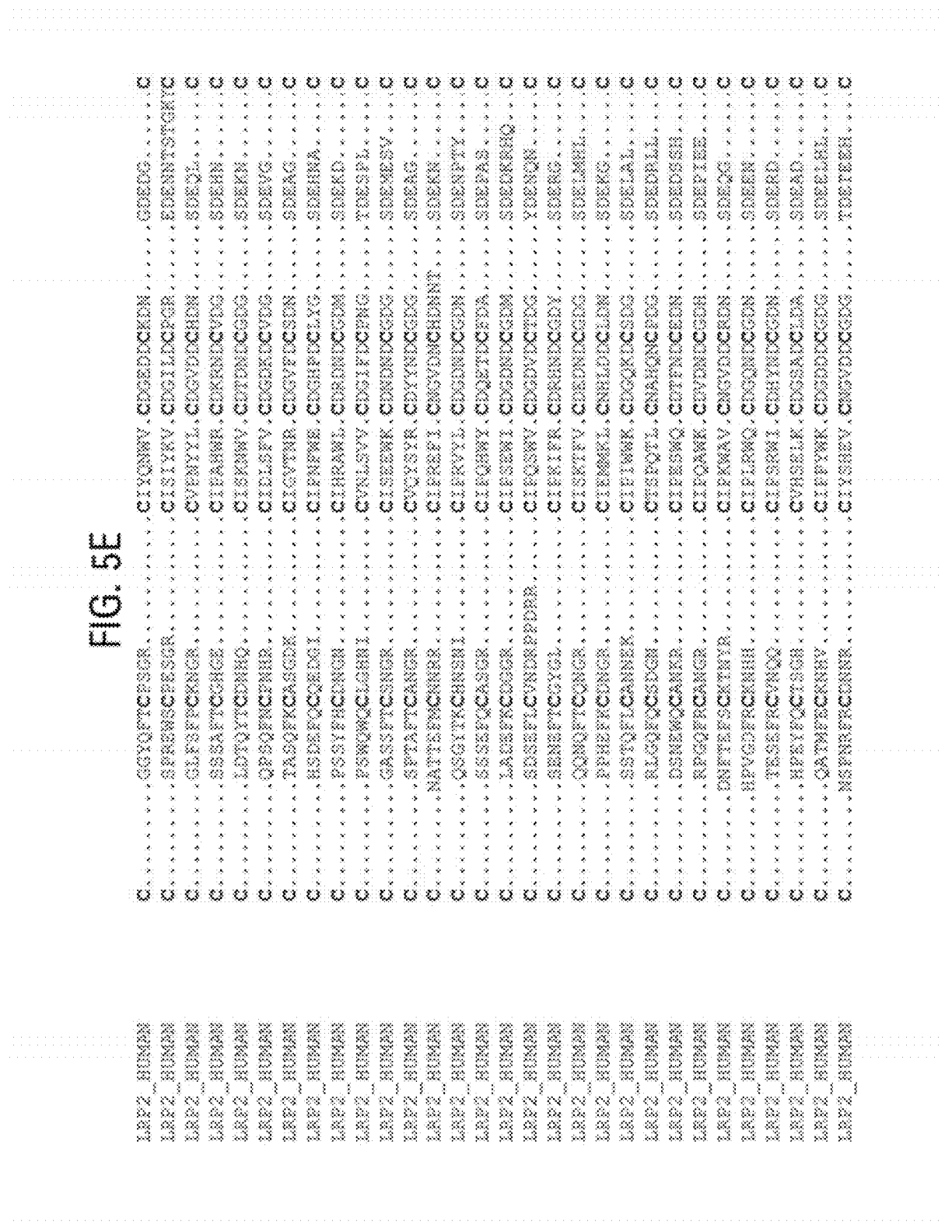
Figure 5F:
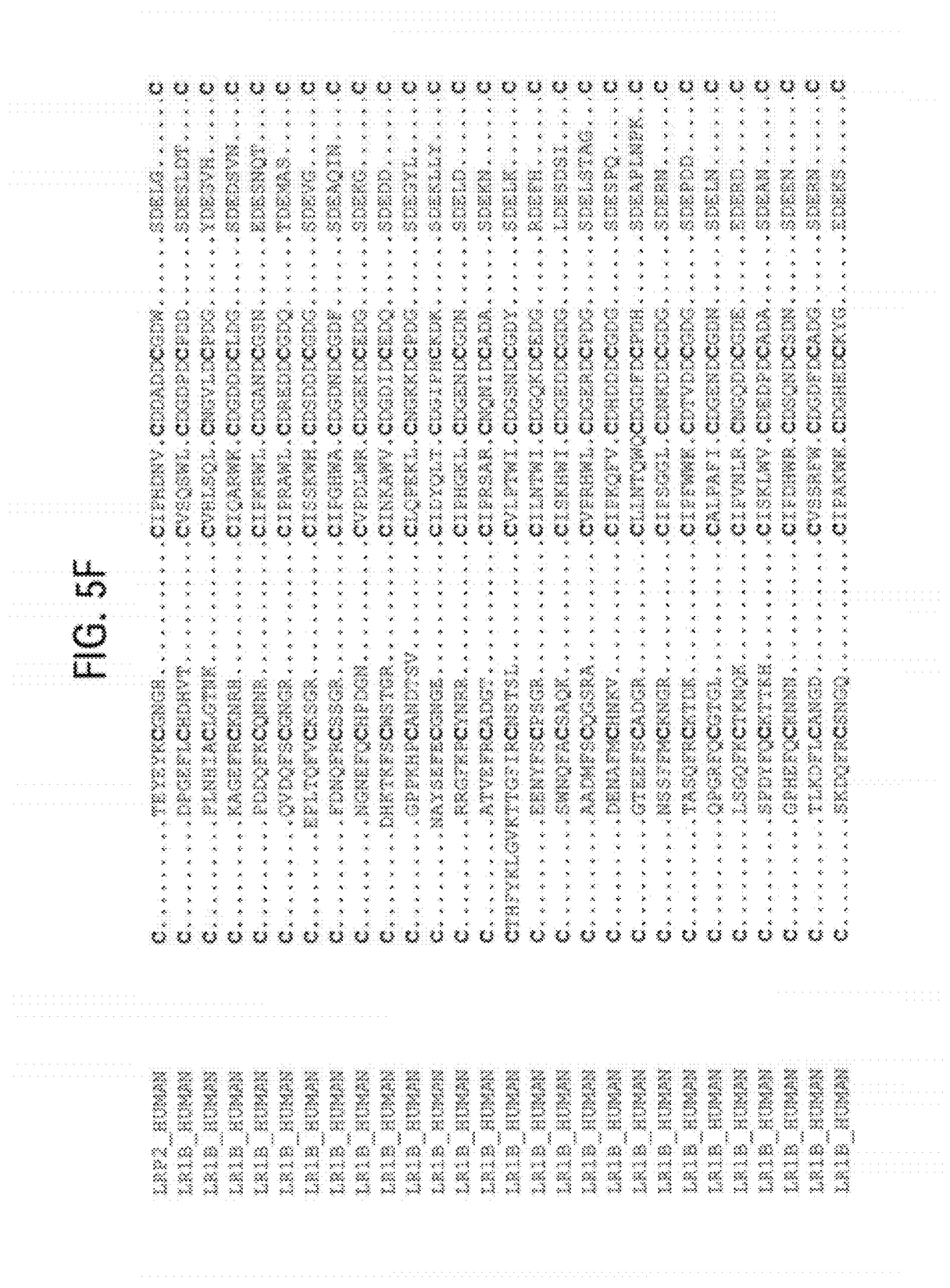
Figure 5G:
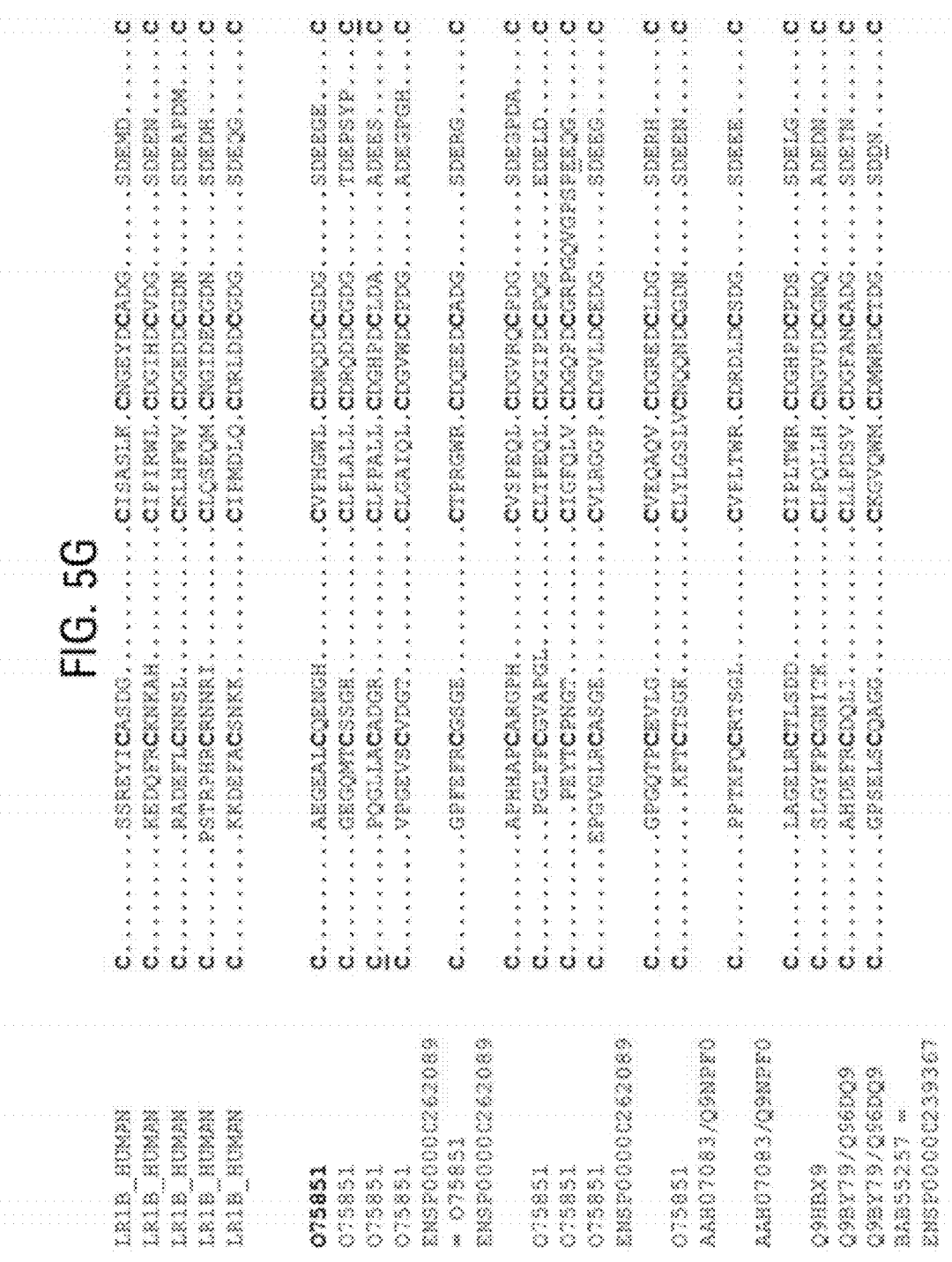
Figure 5H:
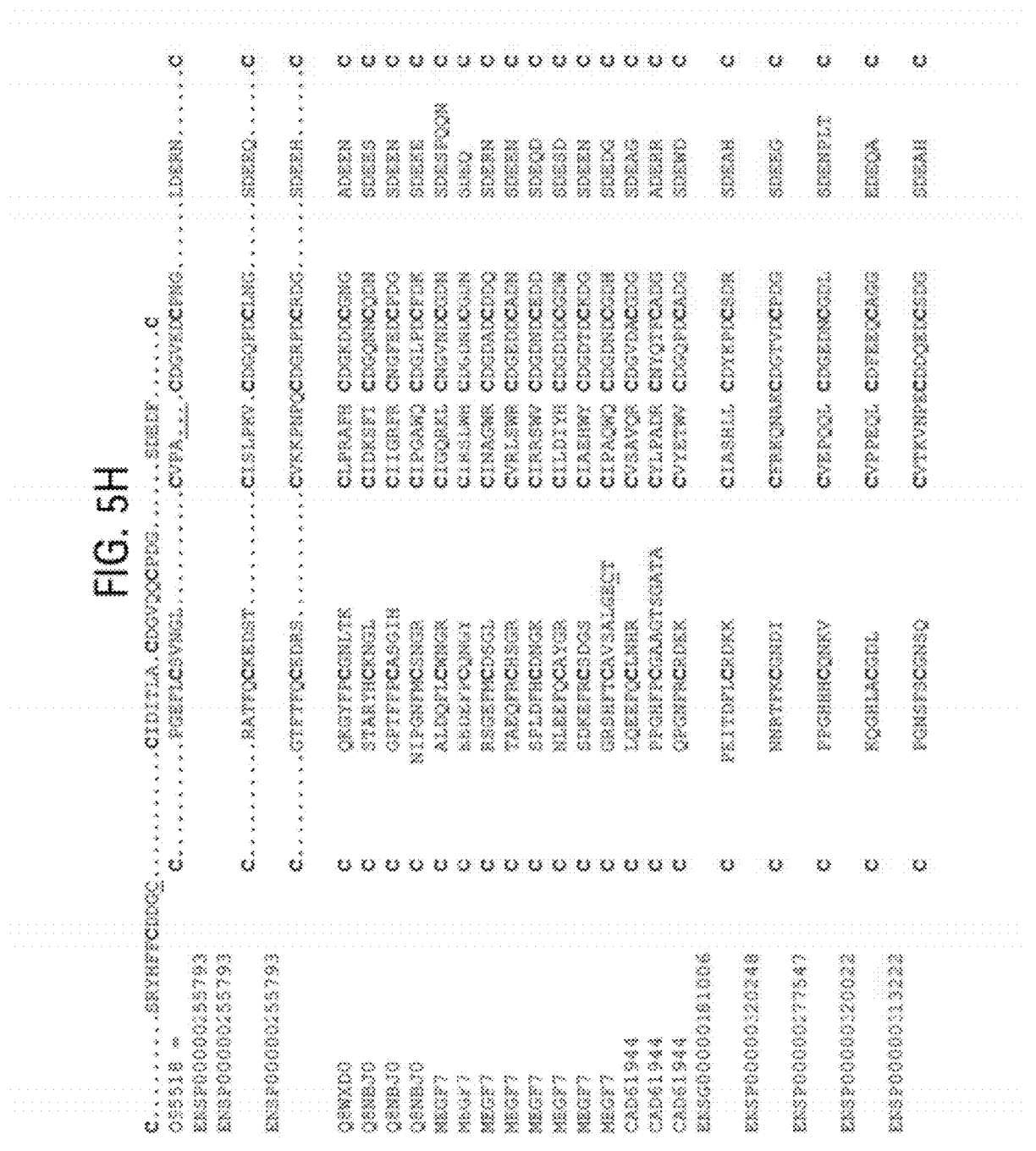

FIGS. 5A-5H are an alignment of A domains (SEQ ID NOS 781-966, 1241 and 967-996, respectively, in order of appearance). At the top of the figure, small letters (a-q) indicate conserved residues.

FIG. 9 is a table depicting examples of various linker sequences that can form an element of a binding protein of the present disclosure; linkers comprising 4 residues; 6 residues; 9 residues (SEQ ID NO: 18), 11 residues (SEQ ID NO: 12), 13 residues (SEQ ID NO: 13) and 15 residues (SEQ ID NO: 14) are shown.

FIG. 10 is a table depicting identified FGFR1c-binding monomers (SEQ ID NOS 997-1029, respectively, in order of appearance) and their properties; the sequences comprise the purification tag SLQKASGALEHHHHHHHH (SEQ ID NO: 1).

FIG. 11 is a table depicting identified β-Klotho-binding monomers derived from panning the naïve A1 scaffold library (SEQ ID NOS 1030-1066, respectively, in order of appearance) and their properties; the sequences comprise the purification tag SLQKASGALEHHHHHHHH (SEQ ID NO: 1).

FIG. 12 is a table depicting identified β-Klotho-binding monomers derived from panning the naïve LNR scaffold library (SEQ ID NOS: 1166 and 1299-1318, respectively, in order of appearance) and their properties; the sequences comprise the purification tag SLQKASGALEHHHHHHHH (SEQ ID NO: 1).

FIG. 13 is a table depicting β-Klotho-binding monomers (SEQ ID NOS 1067-1098, respectively, in order of appearance) generated by mutating the β-Klotho-binding monomers M01, M25, M42 and M50 (SEQ ID NOS 493, 519 and 305-306, respectively, in order of appearance); the sequences comprise the purification tag SLQKASGALEHHHHHHHH (SEQ ID NO: 1).

FIG. 14 is a table depicting dimeric β-Klotho-binding binding proteins (SEQ ID NOS 1099-1159, respectively, in order of appearance) generated based on the β-Klotho-binding monomers M01 (SEQ ID NO: 493), M06 (SEQ ID NO: 499), M08 (SEQ ID NO: 694), M21 (SEQ ID NO: 508), M42 (SEQ ID NO: 305) and M50 (SEQ ID NO:306), as well as the associated EC50 values.

FIG. 15 is a table depicting the sequences of binding proteins (SEQ ID NOS 1160-1179, respectively, in order of appearance) comprising FGFR1c-binding monomers M03 (SEQ ID NO: 287), M08 (SEQ ID NO: 694), M15 (SEQ ID NO:289), M23 (SEQ ID NO: 290), M31 (SEQ ID NO: 291) and M33 (SEQ ID NO: 292), β-Klotho-binding monomers newM03, mutM07, mutM19 and RI M02, and β-Klotho-binding dimers WD01 (SEQ ID NO: 1107), WD02 (SEQ ID NO: 1108), WD31 (SEQ ID NO: 1143), D02 (SEQ ID NO: 1140), D05 (SEQ ID NO: 1155), D06 (SEQ ID NO: 1105), D07 (SEQ ID NO: 1156), D09 (SEQ ID NO: 1123), WD25 (SEQ ID NO: 640) and D25 (SEQ ID NO: 1129) used to generate binding proteins with enhanced properties; the sequences comprise the purification tag SLQKASGALEHH-HHHHHH (SEQ ID NO: 1).

FIG. 16 is a table representing the properties of the binding proteins shown in FIG. 15.

FIGS. 22A-22C is a table depicting binding proteins (SEQ ID NOS 1180-1200, respectively, in order of appearance) comprising β-Klotho-binding monomers M01 (SEQ ID NO: 493), M42 (SEQ ID NO: 305) and M50 (SEQ ID NO: 306) with FGFR1c-binding monomer M15 (SEQ ID NO: 510) in various configurations with either no liner or with a $G_4S$ (SEQ ID NO: 2), $(G_4S)_2$ (SEQ ID NO: 3) or $(G_4S)_3$ (SEQ ID NO: 4) linker; the sequences comprise the purification tag, SLQKASGALEHHHHHHHH (SEQ ID NO: 1).

FIGS. 23A-23C is a table representing the properties of the binding proteins shown in FIG. 22 (SEQ ID NOS 1180-1200, respectively, in order of appearance). (1XG4S) disclosed as SEQ ID NO: 2, (2XG4S) disclosed as SEQ ID NO: 3 and (3XG4S) disclosed as SEQ ID NO: 4.

FIGS. 24A-24C are a series of plots generated using ELISA assays demonstrating that binding proteins C2114 (SEQ ID NO: 1180), C2122 (SEQ ID NO: 1183), C2116 (SEQ ID NO: 1187), C2120 (SEQ ID NO: 1188), C2117 (SEQ ID NO: 1195) and C2121 (SEQ ID NO: 1196) have the ability to bind both FGFR1c and β-Klotho. 3XG4S disclosed as SEQ ID NO: 4 and 1XG4S disclosed as SEQ ID NO: 2.

FIGS. 25A-25B are a series of plots generated using Alphascreen assays demonstrating that binding proteins C2114 (SEQ ID NO: 1180), C2122 (SEQ ID NO: 1183), C2116 (SEQ ID NO: 1187), C2120 (SEQ ID NO: 1188), C2117 (SEQ ID NO: 1195) and C2121 (SEQ ID NO: 1196) have the ability to bind both human and murine β-Klotho (G4S)3 disclosed as SEQ ID NO: 4 and (G4S)1 disclosed as SEQ ID NO: 2.

FIGS. 26A-26B are a series of plots generated using Alphascreen assays demonstrating that binding proteins C2114 (SEQ ID NO: 1180), C2122 (SEQ ID NO: 1183), C2116 (SEQ ID NO: 1187), C2120 (SEQ ID NO: 1188) do not have the ability to block FGF-21 binding to a complex of FGFR1c and β-Klotho and that binding proteins C2117 (SEQ ID NO: 1195) yet C2121 (SEQ ID NO: 1196) do block FGF-21 binding to a complex of FGFR1c and β-Klotho. (G4S)3 disclosed as SEQ ID NO: 4 and (G4S)1 disclosed as SEQ ID NO: 2.

FIGS. 27A-27B are a series of plots generated using Alphascreen assays demonstrating that binding proteins C2114 (SEQ ID NO: 1180), C2122 (SEQ ID NO: 1183), C2116 (SEQ ID NO: 1187), C2120 (SEQ ID NO: 1188), C2117 (SEQ ID NO: 1195) and C2121 (SEQ ID NO: 1196) have the ability to bind both FGFR1c and β-Klotho and do not block the interaction between FGFR1c and β-Klotho. (G4S)3 disclosed as SEQ ID NO: 4 and (G4S)1 disclosed as SEQ ID NO: 2.

FIGS. 29A-29B are a series of plots and tables generated using a flow cytometry assay demonstrating that the binding proteins C2114 (SEQ ID NO: 1180), C2139 (SEQ ID NO: 1181), C2140 (SEQ ID NO: 1182), C2122 (SEQ ID NO: 1183), C2130 (SEQ ID NO: 1184), C2131 (SEQ ID NO: 1185), C2132 (SEQ ID NO: 1186), C2116 (SEQ ID NO: 1187), C2120 (SEQ ID NO: 1188), C2120A (SEQ ID NO: 1188), C2141 (SEQ ID NO: 1189), C2142 (SEQ ID NO: 1190), C2133 (SEQ ID NO: 1191), C2134 (SEQ ID NO: 1192), C2135 (SEQ ID NO: 1193), C2136 (SEQ ID NO: 1194), C2117 (SEQ ID NO: 1195), C2121 (SEQ ID NO: 1196), C2143 (SEQ ID NO: 1197), C2144 (SEQ ID NO: 1198), C2137 (SEQ ID NO: 1199) and C2138 (SEQ ID NO: 1200) exhibit enhanced binding to AM 1D cells expressing human FGFR1c and β-Klotho than their β-Klotho-binding parent monomers (M01, M42 and M50, SEQ ID NOS 493 and 305-306, respectively, in order of appearance); (0XG4S) & (1XG4S) are disclosed as SEQ ID NO: 2, (2XG4S) disclosed as SEQ ID NO: 3 and (3XG4S) disclosed as SEQ ID NO: 4.

FIGS. 31A-31D are a series of bar graphs demonstrating levels of agonistic activity observed in an FGF-21 responsive reporter cell assay for binding proteins generated using the monomers and dimers shown in FIG. 17.

Figure 32A:
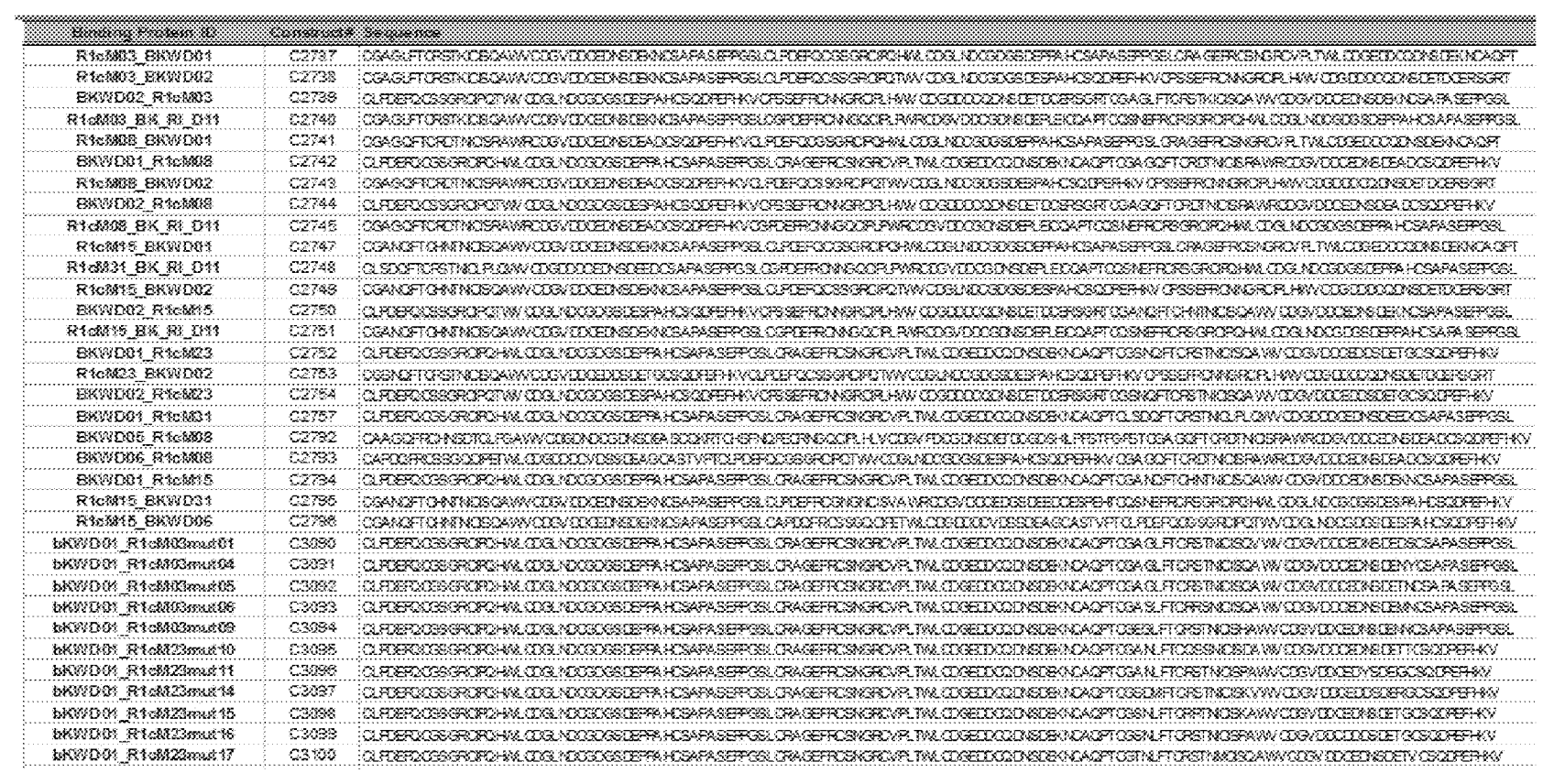
Figure 32B:
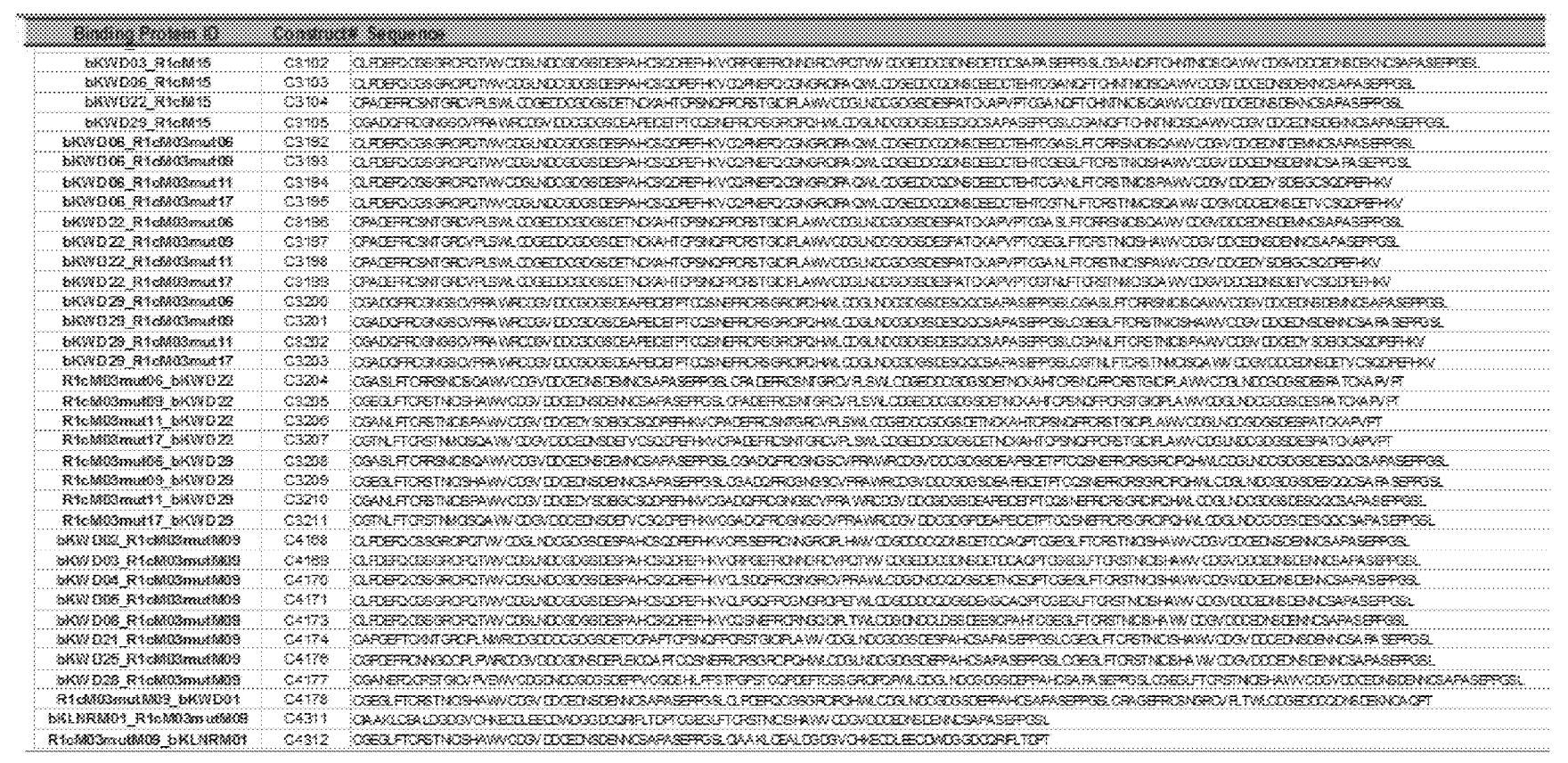

FIG. 32 is a table depicting the sequences of binding proteins (SEQ ID NOS 314-392, 1201-1234 and 1265-1275 respectively, in order of appearance) comprising FGFR1c-binding monomers M03 (SEQ ID NO: 287), M08 (SEQ ID NO: 694), M15 (SEQ ID NO: 289), M31 (SEQ ID NO: 291), M23 (SEQ ID NO: 290), and M33 (SEQ ID NO: 292), M03mutM01 (SEQ ID NO: 293), M03mutM04 (SEQ ID NO: 294), M03mutM05 (SEQ ID NO: 295), M03mutM06 (SEQ ID NO: 296), M03mutM09 (SEQ ID NO: 297), M23mutM10 (SEQ ID NO: 298), M23mutM11 (SEQ ID NO: 299), M23mutM14 (SEQ ID NO: 300), M23mutM15 (SEQ ID NO: 301), M23mutM16 (SEQ ID NO: 302), M23mutM17 (SEQ ID NO: 303), and β-Klotho binding dimers WD01 (SEQ ID NO: 307), WD02 (SEQ ID NO: 308), WD03 (SEQ ID NO:309), WD04 (SEQ ID NO: 601), M03 (SEQ ID NO: 287), RI_D09 (SEQ ID NO:620), WD05 (SEQ ID NO: 605), WD06 (SEQ ID NO: 310), WD21 (SEQ ID NO: 633), WD22 (SEQ ID NO: 311), WD25 (SEQ ID NO: 640), WD28 (SEQ ID NO: 643), WD29 (SEQ ID NO: 312), and WD31 (SEQ ID NO: 656).

FIGS. 38A-38B are a series of plots generated using a cell-based assay that demonstrates that binding proteins C3090 (SEQ ID NO:335), C3091 (SEQ ID NO:336), C3092 (SEQ ID NO:337), C3093 (SEQ ID NO:338), C3094 (SEQ ID NO:339), C3095 (SEQ ID NO:340), C3096 (SEQ ID NO:341), C3097 (SEQ ID NO:342), C3098 (SEQ ID NO:343), C3099 (SEQ ID NO:344), C3100 (SEQ ID NO:345), C3102 (SEQ ID NO:346), C3103 (SEQ ID NO:347), C3104 (SEQ ID NO:348), and C3105 (SEQ ID NO:349) exhibit FGF21-like signaling activity in a first luciferase reporter cell line expressing human FGFR1c and β-Klotho.

FIG. 39A-39B are a series of plots generated using a cell-based assay that demonstrates that binding proteins C3090 (SEQ ID NO:335), C3091 (SEQ ID NO:336), C3092 (SEQ ID NO:337), C3093 (SEQ ID NO:338), C3094 (SEQ ID NO:339), C3095 (SEQ ID NO:340), C3096 (SEQ ID NO:341), C3097 (SEQ ID NO:342), C3098 (SEQ ID NO:343), C3099 (SEQ ID NO:344), C3100 (SEQ ID NO:345), C3102 (SEQ ID NO:346), C3103 (SEQ ID NO:347), C3104 (SEQ ID NO:348), and C3105 (SEQ ID NO:349) exhibit FGF21-like signaling activity in a second luciferase reporter cell line expressing human FGFR1c and β-Klotho.

FIG. 40A-40B are a series of plots generated using a cell-based assay that demonstrates that binding proteins C3090 (SEQ ID NO:335), C3091 (SEQ ID NO:336), C3092 (SEQ ID NO:337), C3093 (SEQ ID NO:338), C3094 (SEQ ID NO:339), C3095 (SEQ ID NO:340), C3096 (SEQ ID NO:341), C3097 (SEQ ID NO:342), C3098 (SEQ ID NO:343), C3099 (SEQ ID NO:344), C3100 (SEQ ID NO:345), C3102 (SEQ ID NO:346), C3103 (SEQ ID NO:347), C3104 (SEQ ID NO:348), and C3105 (SEQ ID NO:349) exhibit FGF21-like signaling activity in a third luciferase reporter cell line expressing human FGFR1c and β-Klotho.

FIG. 41A-41B are a series of plots generated using a cell-based assay that demonstrates that binding proteins C3090 (SEQ ID NO:335), C3091 (SEQ ID NO:336), C3092 (SEQ ID NO:337), C3093 (SEQ ID NO:338), C3094 (SEQ ID NO:339), C3095 (SEQ ID NO:340), C3096 (SEQ ID NO:341), C3097 (SEQ ID NO:342), C3098 (SEQ ID NO:343), C3099 (SEQ ID NO:344), C3100 (SEQ ID NO:345), C3102 (SEQ ID NO:346), C3103 (SEQ ID NO:347), C3104 (SEQ ID NO:348), and C3105 (SEQ ID NO:349) exhibit FGF21-like signaling activity in a fourth luciferase reporter cell line expressing human FGFR1c and β-Klotho.

FIG. 46 is a series of plots generated using cells that do not express β-Klotho, and demonstrate that the ability of binding proteins C3192 (SEQ ID NO:350), C3193 (SEQ ID NO:351), C3194 (SEQ ID NO:352), C3195 (SEQ ID NO:353), C3196 (SEQ ID NO:354), C3197 (SEQ ID NO:355), C3198 (SEQ ID NO:356), C3199 (SEQ ID NO:357), C3200 (SEQ ID NO:358), C3201 (SEQ ID NO:359), C3202 (SEQ ID NO:360), C3203 (SEQ ID NO:361), C3204 (SEQ ID NO:362), C3205 (SEQ ID NO:363), C3206 (SEQ ID NO:364), C3207 (SEQ ID NO:365), C3208 (SEQ ID NO:366), C3209 (SEQ ID NO:367), C3210 (SEQ ID NO:368), and C3211 (SEQ ID NO:369) to induce FGF21-like signaling activity requires the presence of both FGFR1c and β-Klotho.

FIG. 47A-47B are a series of plots generated using cells that express cynomolgus FGFR1c and cynomolgus β-Klotho, and demonstrate that binding proteins C3090 (SEQ ID NO:335), C3091 (SEQ ID NO:336), C3092 (SEQ ID NO:337), C3093 (SEQ ID NO:338), C3094 (SEQ ID NO:339), C3095 (SEQ ID NO:340), C3096 (SEQ ID NO:341), C3097 (SEQ ID NO:342), C3098 (SEQ ID NO:343), C3099 (SEQ ID NO:344), C3100 (SEQ ID NO:345), C3102 (SEQ ID NO:346), C3103 (SEQ ID NO:347), C3104 (SEQ ID NO:348), C3105 (SEQ ID NO:349), C2739 (SEQ ID NO:372) and C2752 (SEQ ID NO:384) exhibit FGF21-like signaling activity in a fourth luciferase reporter cell line stably expressing human FGFR1c and transiently transfected with cynomolgus monkey β-Klotho; the amino acid sequences for human FGFR1c and cynomolgus monkey FGFR1c are identical.

FIG. 48 is a series of plots generated using cells that express cynomolgus FGFR1c and cynomolgus β-Klotho, and demonstrate that binding proteins C3192 (SEQ ID NO:350), C3193 (SEQ ID NO:351), C3194 (SEQ ID NO:352), C3195 (SEQ ID NO:353), C3196 (SEQ ID NO:354), C3197 (SEQ ID NO:355), C3198 (SEQ ID NO:356), C3199 (SEQ ID NO:357), C3200 (SEQ ID NO:358), C3201 (SEQ ID NO:359), C3202 (SEQ ID NO:360), C3203 (SEQ ID NO:361), C3204 (SEQ ID NO:362), C3205 (SEQ ID NO:363), C3206 (SEQ ID NO:364), C3207 (SEQ ID NO:365), C3208 (SEQ ID NO:366), C3209 (SEQ ID NO:367), C3210 (SEQ ID NO:368), and C3211 (SEQ ID NO:369) exhibit FGF21-like signaling activity in a fourth luciferase reporter cell line stably expressing human FGFR1c and transiently transfected with cynomolgus monkey β-Klotho; the amino acid sequences for human FGFR1c and cynomolgus monkey FGFR1c are identical.

FIG. 49A-49B are a series of plots generated using cells that express human FGFR1c and human β-Klotho, and demonstrate that binding proteins C3094 (SEQ ID NO: 339), C4168 (SEQ ID NO: 1265), C4169 (SEQ ID NO: 1266), C4170 (SEQ ID NO: 1267), C4171 (SEQ ID NO: 1268), C4172 (SEQ ID NO: 351), C4173 (SEQ ID NO: 1269), C4174 (SEQ ID NO: 1270), C4175 (SEQ ID NO: 355), C4176 (SEQ ID NO: 1271), C4177 (SEQ ID NO: 1272), and C4178 (SEQ ID NO: 1273) are able to induce FGF21-like signaling.

FIG. 50A-50B are a series of plots generated using four different stable luciferase reporter lines which express luciferase when stimulated with FGF-21, and demonstrate that binding proteins C4311 (LNRM01_R1cM03mutM09) (SEQ ID NO: 1274) and C4312 (R1cM03mutM09_LNRM01) (SEQ ID NO: 1275) are able to induce FGF21-like signaling.

DETAILED DESCRIPTION OF THE INVENTION

Definitions

Figure 1:
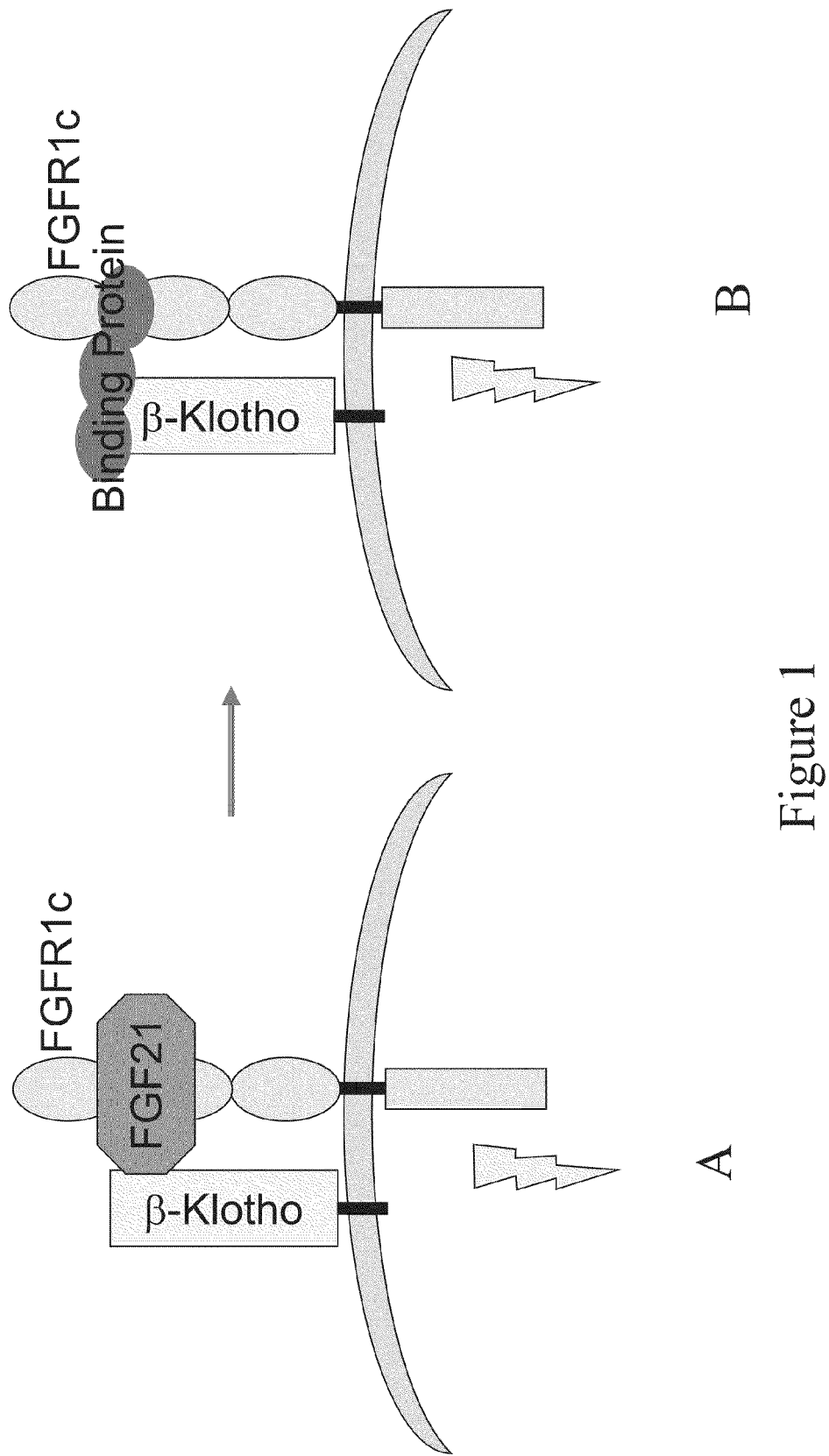
FIG. 1 is a cartoon schematically depicting how the binding proteins disclosed herein mimic the in vivo signaling activity of FGF21.
Figure 6:
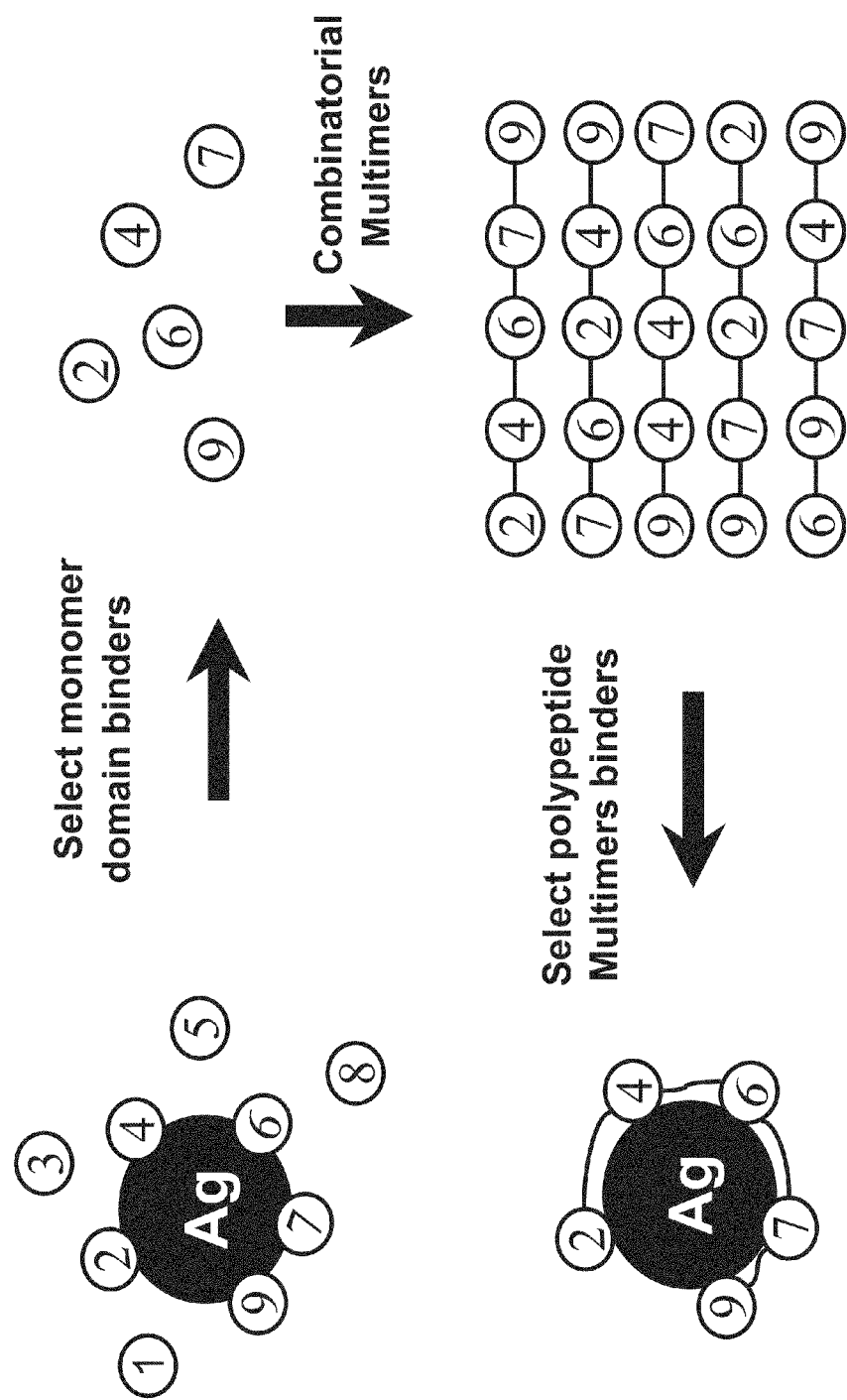
FIG. 6 is a cartoon schematically illustrating a general scheme for identifying monomer domains that bind to a target protein, isolating the selected monomer domains, creating multimers of the selected monomer domains by joining the selected monomer domains in various combinations and screening the multimers to identify multimers comprising more than one monomer that binds to a ligand.

The section headings used herein are for organizational purposes only and are not to be construed as limiting the subject matter described.

Unless otherwise defined herein, scientific and technical terms used in connection with the present application shall have the meanings that are commonly understood by those of ordinary skill in the art. Further, unless otherwise required by context, singular terms shall include pluralities and plural terms shall include the singular.

Following standard convention, as used herein, "a" and "an" mean one or more unless specifically indicated otherwise.

As used herein, use of parentheses in a sequence motif indicates that that the positions within the brackets can be present or absent (e.g., "[ekq]" indicates that the position is absent or either E, K, or Q can be at that position). When more than one "x" is used in parentheses (e.g., "[xx]"), each x represents a possible position. Thus "[xx]" indicates that zero, one or two amino acids can be at that position(s), where each amino acid is independently selected from any amino acid. Absent amino acids can also be designated by "–."

The term "FGF21-like signaling activity" means exhibiting an FGF21-like agonistic efficacy level of equal to or greater than 5% 10%, 15%, 20%, 25%, 30%, 35%, 40%, 45%, 50%, 55%, 60%, 65%, 70%, 75%, 80%, 85% and preferably equal to or greater than 90%, 95%, 96%, 97%, 98%, 99%, or 100% of the activity of FGF21 in one of the following assays: (1) a reporter, e.g. luciferase, assay in a recombinant cell line engineered to respond to FGF21 such as the assay described in Example 9; (2) an assay that demonstrates changes in the downstream signaling molecules, e.g., ERK-phosphorylation in a recombinant cell line, e.g., rat myoblastic L6 cells engineered to respond to FGF21, such as the assay described in Example 10; and (3) an assay that demonstrates changes in the downstream signaling molecules, e.g., ERK-phosphorylation in primary human adipocytes which respond to FGF21, such as the assay described in Example 11. The "potency" of the substantial activity of such a binding protein is defined as having EC50 of equal of or less than 100 nM and preferably less than 10 nM of the binding protein in the aforementioned assays.

As used herein, the term "binding protein" refers to a protein that specifically binds a specified target protein, such as FGFR1c, β-Klotho or both FGFR1c and β-Klotho, e.g., human FGFR1c, human β-Klotho or both human FGFR1c and human β-Klotho. A binding protein can comprise one or more monomers, as defined and described herein, joined to one another via a linker sequence to form a "multimer." For clarity, the definition of a binding protein specifically excludes antibodies.

A binding protein is said to "specifically bind" its target when the dissociation constant ($K_D$) is $\leq 10^{-7}$ M. A binding protein specifically binds its target with "high affinity" when the $K_D$ is $\leq 5 \times 10^{-9}$ M, and with "very high affinity" when the $K_D$ is $\leq 5 \times 10^{-10}$ tested using a binding assay, such as the assay described in Example 7. In one embodiment, a binding protein will bind to FGFR1c, β-Klotho or both FGFR1c and β-Klotho, e.g. human FGFR1c, human β-Klotho or both human FGFR1c and human β-Klotho, with an EC50 of between about $10^{-8}$ M and $10^{-10}$ M as determined by binding ELISA, and in yet another embodiment the binding proteins will bind with a EC50$\leq 5 \times 10^{-9}$ as determined by binding ELISA. Thus, the phrase "specifically (or selectively) binds" to a polypeptide, when referring to a monomer, multimer, or binding protein, refers to a binding reaction that can be determinative of the presence of the polypeptide in a heterogeneous population of proteins (e.g., a cell or tissue lysate) and other biologics. Thus, under standard conditions or assays used in antibody binding assays, a binding protein (e.g., a monomer or multimer) specifically binds to a particular target molecule above background (e.g., 2×, 5×, 10× or more above background) and does not bind in a significant amount to other molecules present in the sample.

The terms "monomer domain" or "monomer" are used interchangeably herein refer to a discrete region found in a protein or polypeptide. A monomer domain can form a native three-dimensional structure in solution in the absence of flanking native amino acid sequences. Some monomer domains disclosed herein can specifically bind to a target molecule. For example, a polypeptide that forms a three-dimensional structure that binds to a target molecule is a monomer domain. As used herein, the term "monomer domain" does not encompass the complementarity determining region (CDR) of an antibody. Two or more monomers can be joined to one another via a linker sequence to form a multimer.

The term "monomer domain variant" refers to a monomer domain resulting from human manipulation of a monomer domain sequence. Examples of human-manipulated changes include, e.g., random mutagenesis, site-specific mutagenesis, recombining, directed evolution, oligo-directed forced crossover events, direct gene synthesis incorporation of mutation, etc. The term "monomer domain variant" does not embrace a mutagenized complementarity determining region (CDR) of an antibody.

The term "loop" refers to a portion of a monomer domain that is typically exposed to the environment by the assembly of the scaffold structure of the monomer domain protein, and which is involved in target binding. The present disclosure provides three types of loops that are identified by specific features, such as, potential for disulfide bonding, bridging between secondary protein structures, and molecular dynamics (e.g., flexibility). The three types of loop sequences are a cysteine-defined loop sequence, a structure-defined loop sequence, and a B-factor-defined loop sequence.

As used herein, the term "cysteine-defined loop sequence" refers to a subsequence of a naturally occurring monomer domain-encoding sequence that is bound at each end by a cysteine residue that is conserved with respect to at least one other naturally occurring monomer domain of the same family. Cysteine-defined loop sequences are identified by multiple sequence alignment of the naturally occurring monomer domains, followed by sequence analysis to identify conserved cysteine residues. The sequence between each consecutive pair of conserved cysteine residues is a cysteine-defined loop sequence. The cysteine-defined loop sequence does not include the cysteine residues adjacent to each terminus Monomer domains having cysteine-defined loop sequences include the LDL receptor A-domains, EGF-like domains, sushi domains, Fibronectin type 1 domains, and the like. Thus, for example, in the case of LDL receptor A-domains represented by the consensus sequence, $CX_6CX_4CX_6CX_5CX_8C$ (SEQ ID NO: 5), wherein $X_6$, $X_4$, $X_5$, and $X_8$ each represent a cysteine-defined loop sequence comprising the designated number of amino acids.

The term "B-factor-defined loop sequence" refers to a subsequence of at least three amino acid residues of a monomer-domain encoding sequence in which the B-factors for the alpha carbons in the B-factor-defined loop are among the 25% highest alpha carbon B factors in the entire monomer domain. Typically the average alpha-carbon B-factor for the subsequence is at least about 65. As used herein, the term "B-factor" (or "temperature factor" or "Debye-Waller factor") is derived from X-ray scattering data. The B-factor is a factor that can be applied to the X-ray scattering term for each atom, or for groups of atoms, that describes the degree to which electron density is spread out B-factors employed in the practice disclosed herein can be either isotropic or anisotropic. The term "average alpha-carbon B-factor" refers to:

$$\left(\sum_{i=1}^{n} B\text{-}factor_{C\alpha i}\right)/n$$

where n corresponds to the number of residues in the loop, and is at least 3, and B-factor$_{C\alpha i}$ is the B-factor for the alpha carbon of amino acid residue i of the loop.

The term "multimer" is used herein to indicate a protein comprising at least two monomer domains. The separate monomer domains in a multimer can be joined together by a linker. A multimer is also known as a combinatorial mosaic protein or a recombinant mosaic protein.

The term "family" and "family class" are used interchangeably to indicate proteins that are grouped together based on similarities in their amino acid sequences. These similar sequences are generally conserved because they are important for the function of the protein and/or the maintenance of the three dimensional structure of the protein. Examples of such families include LDL Receptor A-domain family, the FGF19 subfamily of the FGF family, and the like. Additionally, related sequences that bind to the same target molecule can be divided into families based on common sequence motifs.

The term "ligand," also referred to herein as a "target molecule," encompasses a wide variety of substances and molecules, which range from simple molecules to complex targets. Target molecules can be proteins, nucleic acids, lipids, carbohydrates or any other molecule capable of recognition by a monomer domain. For example, a target molecule can include a chemical compound (i.e., non-biological compound such as, e.g., an organic molecule, an inorganic molecule, or a molecule having both organic and inorganic atoms, but excluding polynucleotides and proteins), a mixture of chemical compounds, an array of spatially localized compounds, a biological macromolecule, a bacteriophage peptide display library, a polysome peptide display library, an extract made from a biological materials such as bacteria, plants, fungi, or animal (e.g., mammalian) cells or tissue, a protein, a toxin, a peptide hormone, a cell, a virus, or the like. Other target molecules include, e.g., a whole cell, a whole tissue, a mixture of related or unrelated proteins, a mixture of viruses or bacterial strains or the like. Target molecules can also be defined by inclusion in screening assays described herein or by enhancing or inhibiting a specific protein interaction (i.e., an agent that selectively inhibits a binding interaction between two predetermined polypeptides). Examples of target molecules include β-Klotho and FGFR1c.

The term "linker" is used herein to indicate a moiety or group of moieties that joins or connects two or more discrete separate monomer domains. A linker allows the discrete separate monomer domains to remain separate when joined together in a multimer. A linker moiety is typically a substantially linear moiety. Suitable linkers include polypeptides, polynucleic acids, peptide nucleic acids and the like. Suitable linkers also include optionally substituted alkylene moieties that have one or more oxygen atoms incorporated in the carbon backbone. Typically, the molecular weight of the linker is less than about 2000 daltons. More typically, the molecular weight of the linker is less than about 1500 daltons and often is less than about 1000 daltons. A linker can be small enough to allow the discrete separate monomer domains to cooperate, e.g., where each of the discrete separate monomer domains in a multimer binds to the same target molecule via separate binding sites. Exemplary linkers include a polynucleotide encoding a polypeptide, or a polypeptide of amino acids or other non-naturally occurring moieties. A linker can be a portion of a native sequence, a variant thereof, or a synthetic sequence. Linkers can comprise, e.g., naturally occurring, non-naturally occurring amino acids, or a combination of both. Examples of particular linkers that can be employed in the binding proteins disclosed herein include ATHT (SEQ ID NO: 6), PERT (SEQ ID NO: 7), TTRT (SEQ ID NO: 8), GTTGPT (SEQ ID NO: 9), ETSGPT (SEQ ID NO: 10), SQDPEFHKVS (SEQ ID NO: 11), SAPASEPPGSL (SEQ ID NO: 12), GRPGPGATSAPAA (SEQ ID NO: 13), GDSHILPFSTPGPST (SEQ ID NO: 14), [AEKPT][AEKLPT][EHPR]T (SEQ ID NO: 15), [AEKRT][AGS][APSV][AEGV][HP]T (SEQ ID NO: 16), PTKRPEEV (SEQ ID NO: 17), SQDPEFHKV (SEQ ID NO: 18), SAPASEPPGSL (SEQ ID NO: 12), GRPGPGATSAPAA (SEQ ID NO: 13), GDSHILPFSTPGPST (SEQ ID NO: 14), [AEPT][AEPQ][HP]T (SEQ ID NO: 22), [EGT][AGR][AST][EGV][PR]T (SEQ ID NO: 23), KAPVPT (SEQ ID NO: 24), SQDPGFHKV (SEQ ID NO: 25), [APK][AT][HPR]T (SEQ ID NO: 26), [EQ][ART][HP]T (SEQ ID NO: 27), EQRT (SEQ ID NO: 28), RRAAHT (SEQ ID NO: 29), [AK][AG][PS][EG][HP]T (SEQ ID NO: 30), ETPT (SEQ ID NO: 1319), PAPT (SEQ ID NO:1320), QAPT (SEQ ID NO:1321), AQPT (SEQ ID NO:1322), and sequences comprising conservative substitutions, wherein amino acids in brackets indicate alternative amino acids at a specified position.

The term "separate" is used herein to indicate a property of a moiety that is independent and remains independent even when complexed with other moieties, including for example, other monomer domains. A monomer domain is a separate domain in a protein because it has an independent property that can be recognized and separated from the protein. For instance, the ligand binding ability of FGFR1c is an independent property. Other examples of separate include the separate monomer domains in a multimer that remain separate independent domains even when complexed or joined together in the multimer by a linker. Another example of a separate property is the separate binding sites in a multimer for a ligand.

As used herein, "directed evolution" refers to a process by which polynucleotide variants are generated, expressed, and screened for an activity (e.g., a polypeptide with binding activity) in a recursive process. One or more candidates in the screen are selected and the process is then repeated using polynucleotides that encode the selected candidates to generate new variants. Directed evolution involves at least two rounds of variation generation and can include 3, 4, 5, 10, 20 or more rounds of variation generation and selection. Variation can be generated by any method known to those of skill in the art, including, e.g., by error-prone PCR, gene recombination, chemical mutagenesis and the like.

The term "shuffling" is used herein to indicate recombination between non-identical sequences. In some embodiments, shuffling can include crossover via homologous recombination or via non-homologous recombination, such as via cre/lox and/or flp/frt systems. Shuffling can be carried out by employing a variety of different formats, including for example, in vitro and in vivo shuffling formats, in silico shuffling formats, shuffling formats that utilize either double-stranded or single-stranded templates, primer based shuffling formats, nucleic acid fragmentation-based shuffling formats, and oligonucleotide-mediated shuffling formats, all of which are based on recombination events between non-identical sequences and are described in more detail or referenced herein below, as well as other similar recombination-based formats.

The term "random" as used herein refers to a polynucleotide sequence or an amino acid sequence composed of two or more amino acids and constructed by a stochastic or random process. The random polynucleotide sequence or amino acid sequence can include framework or scaffolding motifs, which can comprise invariant sequences.

The term "pseudorandom" as used herein refers to a set of polynucleotide or polypeptide sequences that have limited variability, so that the degree of residue variability at some positions is limited, but any pseudorandom position is allowed at least some degree of residue variation.

The terms "polypeptide," "peptide," and "protein" are used herein interchangeably to refer to an amino acid sequence of two or more amino acids.

The term "amino acid" refers to naturally occurring and synthetic amino acids, as well as amino acid analogs/amino acid mimetics/non-naturally occurring amino acids that function in a manner similar to the naturally occurring amino acids. Naturally occurring amino acids are those encoded by the genetic code, as well as those amino acids that are later modified, e.g., hydroxyproline, γ-carboxyglutamate, and O-phosphoserine. Amino acid analogs refers to compounds that have the same basic chemical structure as a naturally occurring amino acid, i.e., an α carbon that is bound to a hydrogen, a carboxyl group, an amino group, and an R group, e.g., homoserine, norleucine, methionine sulfoxide, methionine methyl sulfonium. Such analogs have modified R groups (e.g., norleucine) or modified peptide backbones, but retain the same basic chemical structure as a naturally occurring amino acid. An "amino acid mimetic" is a chemical compound that has a structure that is different from the general chemical structure of an amino acid, but that functions in a manner similar to a naturally occurring amino acid. A "non-naturally occurring amino acid" is a compound that has the same basic chemical structure as a naturally occurring amino acid, but is not incorporated into a growing polypeptide chain by the translation complex. "Non-naturally occurring amino acid" also includes, but is not limited to, amino acids that occur by modification (e.g., posttranslational modifications) of a naturally encoded amino acid (including but not limited to, the 20 common amino acids) but are not themselves naturally incorporated into a growing polypeptide chain by the translation complex. A non-limiting lists of examples of non-naturally occurring amino acids that can be inserted into a binding protein sequence or substituted for a wild-type residue in an antigen binding sequence include β-amino acids, homoamino acids, cyclic amino acids and amino acids with derivatized side chains. Examples include (in the L-form or D-form; abbreviated as in parentheses): citrulline (Cit), homocitrulline (hCit), Nα-methylcitrulline (NMeCit), Nα-methylhomocitrulline (Nα-MeHoCit), ornithine (Orn), Nα-Methylornithine (Nα-MeOrn or NMeOrn), sarcosine (Sar), homolysine (hLys or hK), homoarginine (hArg or hR), homoglutamine (hQ), Nα-methylarginine (NMeR), Nα-methylleucine (Nα-MeL or NMeL), N-methylhomolysine (NMe-HoK), Nα-methylglutamine (NMeQ), norleucine (Nle), norvaline (Nva), 1,2,3,4-tetrahydroisoquinoline (Tic), Octahydroindole-2-carboxylic acid (Oic), 3-(1-naphthyl)alanine (1-Nal), 3-(2-naphthyl)alanine (2-Nal), 1,2,3,4-tetrahydroisoquinoline (Tic), 2-indanylglycine (IgI), para-iodophenylalanine (pI-Phe), para-aminophenylalanine (4AmP or 4-Amino-Phe), 4-guanidino phenylalanine (Guf), glycyllysine (abbreviated "K(Nε-glycyl)" or "K(glycyl)" or "K(gly)"), nitrophenylalanine (nitrophe), aminophenylalanine (aminophe or Amino-Phe), benzylphenylalanine (benzylphe), γ-carboxyglutamic acid (γ-carboxyglu), hydroxyproline (hydroxypro), p-carboxyl-phenylalanine (Cpa), α-aminoadipic acid (Aad), Nα-methyl valine (NMeVal), N-α-methyl leucine (NMeLeu), Nα-methylnorleucine (NMeNle), cyclopentylglycine (Cpg), cyclohexylglycine (Chg), acetylarginine (acetylarg), α, β-diaminopropionoic acid (Dpr), α, γ-diaminobutyric acid (Dab), diaminopropionic acid (Dap), cyclohexylalanine (Cha), 4-methyl-phenylalanine (MePhe), β, β-diphenyl-alanine (BiPhA), aminobutyric acid (Abu), 4-phenyl-phenylalanine (or biphenylalanine; 4Bip), α-amino-isobutyric acid (Aib), beta-alanine, beta-aminopropionic acid, piperidinic acid, aminocaprioic acid, aminoheptanoic acid, aminopimelic acid, desmosine, diaminopimelic acid, N-ethylglycine, N-ethylaspargine, hydroxylysine, allo-hydroxylysine, isodesmosine, allo-isoleucine, N-methylglycine, N-methylisoleucine, N-methylvaline, 4-hydroxyproline (Hyp), γ-carboxyglutamate, ε-N,N,N-trimethyllysine, ε-N-acetyllysine, O-phosphoserine, N-acetylserine, N-formylmethionine, 3-methylhistidine, 5-hydroxylysine, ω-methylarginine, 4-Amino-O-Phtalic Acid (4APA), and other similar amino acids, and derivatized forms of any of those specifically listed.

"Conservative amino acid substitution" refers to the interchangeability of residues having similar side chains. For example, a group of amino acids having aliphatic side chains is glycine, alanine, valine, leucine, and isoleucine; a group of amino acids having aliphatic-hydroxyl side chains is serine and threonine; a group of amino acids having amide-containing side chains is asparagine and glutamine; a group of amino acids having aromatic side chains is phenylalanine, tyrosine, and tryptophan; a group of amino acids having basic side chains is lysine, arginine, and histidine; and a group of amino acids having sulfur-containing side chains is cysteine and methionine. Preferred conservative amino acids substitution groups are: valine-leucine-isoleucine, phenylalanine-tyrosine, lysine-arginine, alanine-valine, and asparagine-glutamine.

As used herein the term "recombinant," when used in the context of a binding protein, monomer or multimer, means that the binding protein, monomer or multimer is not found in nature and cannot be isolated from an un-altered source found in nature (e.g., a cell, tissue or biological fluid). When the term is used with reference to, e.g., a cell, or nucleic acid, protein, or vector, it indicates that the cell, nucleic acid, protein or vector, has been modified by the introduction of a heterologous nucleic acid or protein or the alteration of a native nucleic acid or protein, or that the cell is derived from a cell so modified. Thus, for example, recombinant cells express genes that are not found within the native (nonrecombinant) form of the cell or express native genes that are otherwise abnormally expressed, under-expressed or not expressed at all.

As used herein the term "non-recombinant," when used in the context of a binding protein, monomer or multimer, means that the binding protein, monomer or multimer is found in nature and can be isolated from a un-altered source found in nature (e.g., a cell, tissue or biological fluid).

The phrase "nucleic acid sequence" refers to a single or double-stranded polymer of deoxyribonucleotide or ribonucleotide bases read from the 5' to the 3' end or an analog thereof.

The term "encoding" refers to a polynucleotide sequence encoding one or more amino acids. The term does not require a start or stop codon. An amino acid sequence can be encoded in any one of six different reading frames provided by a polynucleotide sequence.

The term "promoter" refers to regions or sequence located upstream and/or downstream from the start of transcription that are involved in recognition and binding of RNA polymerase and other proteins to initiate transcription.

A "vector" refers to a polynucleotide, which when independent of the host chromosome, is capable of replication in a host organism. Examples of vectors include plasmids. Vectors typically have an origin of replication. Vectors can comprise, e.g., transcription and translation terminators, transcription and translation initiation sequences, and promoters useful for regulation of the expression of the particular nucleic acid.

The terms "identical" or percent "identity," in the context of two or more nucleic acids or polypeptide sequences, refer to two or more sequences or subsequences that are the same. "Percent identity" means the percent of identical residues between the amino acids or nucleotides in the compared molecules and is calculated based on the size of the smallest of the molecules being compared. For these calculations, gaps in alignments (if any) must be addressed by a particular mathematical model or computer program (i.e., an "algorithm"). Methods that can be used to calculate the identity of the aligned nucleic acids or polypeptides include those described in *Computational Molecular Biology*, (Lesk, A. M., ed.), (1988) New York: Oxford University Press; Biocomputing Informatics and Genome Projects, (Smith, D. W., ed.), 1993, New York: Academic Press; Computer Analysis of Sequence Data, Part I, (Griffin, A. M., and Griffin, H. G., eds.), 1994, New Jersey: Humana Press; von Heinje, G., (1987) Sequence Analysis in Molecular Biology, New York: Academic Press; Sequence Analysis Primer, (Gribskov, M. and Devereux, J., eds.), 1991, New York: M. Stockton Press; and Carillo et al., (1988) *SIAM J. Applied Math.* 48:1073.

In calculating percent identity, the sequences being compared are aligned in a way that gives the largest match between the sequences. The computer program used to determine percent identity is the GCG program package, which includes GAP (Devereux et al., (1984) *Nucl. Acid Res.* 12:387; Genetics Computer Group, University of Wisconsin, Madison, Wis.). The computer algorithm GAP is used to align the two polypeptides or polynucleotides for which the percent sequence identity is to be determined. The sequences are aligned for optimal matching of their respective amino acid or nucleotide (the "matched span", as determined by the algorithm) A gap opening penalty (which is calculated as 3× the average diagonal, wherein the "average diagonal" is the average of the diagonal of the comparison matrix being used; the "diagonal" is the score or number assigned to each perfect amino acid match by the particular comparison matrix) and a gap extension penalty (which is usually 1/10 times the gap opening penalty), as well as a comparison matrix such as PAM 250 or BLOSUM 62 are used in conjunction with the algorithm. In certain embodiments, a standard comparison matrix (see, Dayhoff et al., (1978) *Atlas of Protein Sequence and Structure* 5:345-352 for the PAM 250 comparison matrix; Henikoff et al., (1992) *Proc. Natl. Acad. Sci. U.S.A.* 89:10915-10919 for the BLOSUM 62 comparison matrix) is also used by the algorithm.

Recommended parameters for determining percent identity for polypeptides or nucleotide sequences using the GAP program are the following:

Algorithm: Needleman et al., 1970, *J. Mol. Biol.* 48:443-453;

Comparison matrix: BLOSUM 62 from Henikoff et al., 1992, supra;

Gap Penalty: 12 (but with no penalty for end gaps)

Gap Length Penalty: 4

Threshold of Similarity: 0

Certain alignment schemes for aligning two amino acid sequences can result in matching of only a short region of the two sequences, and this small aligned region can have very high sequence identity even though there is no significant relationship between the two full-length sequences. Accordingly, the selected alignment method (e.g., the GAP program) can be adjusted if so desired to result in an alignment that spans at least 50 contiguous amino acids of the target polypeptide.

"Substantially identical" refers to two or more nucleic acids or polypeptide sequences having a specified percentage of amino acid residues or nucleotides that are the same (e.g., 60% identity, optionally 65%, 70%, 75%, 80%, 85%, 90%, or 95% identity over a specified region, or, when not specified, over the entire sequence), when compared and aligned for maximum correspondence over a comparison window, or designated region as measured using one of the following sequence comparison algorithms or by manual alignment and visual inspection. Optionally, the identity or substantial identity exists over a region that is at least about 50 nucleotides in length, or over a region that is 100 to 500 or 1000 or more nucleotides or amino acids in length, or if not specified, over the length of a sequence. The present disclosure provides polypeptides comprising binding sequences that bind to FGFR1c, β-Klotho or both FGFR1c and β-Klotho, wherein the binding sequences are substantially identical (e.g., at least 65%, 70%, 75%, 80%, 85%, 90%, or 95% identical) to at least one binding sequence that binds to FGFR1c and β-Klotho, as provided herein, including but not limited to, any of SEQ ID NOS:335-392 and SEQ ID NOS:1180-1200.

A polynucleotide or amino acid sequence is "heterologous to" a second sequence if the two sequences are not linked in the same manner as found in naturally-occurring sequences. For example, a promoter operably linked to a heterologous coding sequence refers to a coding sequence which is different from any naturally-occurring allelic variants. The term "heterologous linker," when used in reference to a multimer, indicates that the multimer comprises a linker and a monomer that are not found in the same relationship to each other in nature (e.g., they form a recombinant fusion protein that is not normally expressed in nature).

"Percentage of sequence identity" is determined by comparing two optimally aligned sequences over a comparison window, wherein the portion of the polynucleotide sequence in the comparison window can comprise additions or deletions (i.e., gaps) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison and multiplying the result by 100 to yield the percentage of sequence identity.

A "comparison window", as used herein, includes reference to a segment of any one of the number of contiguous positions selected from the group consisting of from 20 to 600, usually about 50 to about 200, more usually about 100 to about 150 in which a sequence can be compared to a reference sequence of the same number of contiguous positions after the two sequences are optimally aligned. Methods of alignment of sequences for comparison are well-known in the art. Optimal alignment of sequences for comparison can be conducted, e.g., by the local homology algorithm of Smith and Waterman (1970) *Adv. Appl. Math.* 2:482c, by the homology alignment algorithm of Needleman and Wunsch (1970) *J. Mol. Biol.* 48:443, by the search for similarity method of Pearson and Lipman (1988) *Proc. Nat'l. Acad. Sci. USA* 85:2444, by computerized implementations of these algorithms (GAP, BESTFIT, FASTA, and TFASTA in the Wisconsin Genetics Software Package, Genetics Computer Group, 575 Science Dr., Madison, Wis.), or by manual alignment and visual inspection (see, e.g., Ausubel et al., *Current Protocols in Molecular Biology* (1995 supplement)).

One example of a useful algorithm is the BLAST 2.0 algorithm, which is described in Altschul et al. (1990) *J. Mol. Biol.* 215:403-410, respectively. Software for performing BLAST analyses is publicly available through the National Center for Biotechnology Information. This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul et al., supra). These initial neighborhood word hits act as seeds for initiating searches to find longer HSPs containing them. The word hits are extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) or 10, M=5, N=−4 and a comparison of both strands. For amino acid sequences, the BLASTP program uses as defaults a wordlength of 3, and expectation (E) of 10, and the BLOSUM62 scoring matrix (see Henikoff and Henikoff (1989) *Proc. Natl. Acad. Sci. USA* 89:10915) alignments (B) of 50, expectation (E) of 10, M=5, N=−4, and a comparison of both strands.

The BLAST algorithm also performs a statistical analysis of the similarity between two sequences (see, e.g., Karlin and Altschul (1993) *Proc. Natl. Acad. Sci. USA* 90:5873-5787). One measure of similarity provided by the BLAST algorithm is the smallest sum probability (P(N)), which provides an indication of the probability by which a match between two nucleotide or amino acid sequences would occur by chance. For example, a nucleic acid is considered similar to a reference sequence if the smallest sum probability in a comparison of the test nucleic acid to the reference nucleic acid is less than about 0.2, more preferably less than about 0.01, and most preferably less than about 0.001.

I. Introduction

The present disclosure provides binding proteins that can induce FGF21-mediated signaling, as defined herein. In vivo, the mature form of FGF21 is the active form of the molecule. The nucleotide sequence encoding full length FGF21 is provided; the nucleotides encoding the signal sequence are underlined.

```
                                              (SEQ ID NO: 31)
ATG GAC TCG GAC GAG ACC GGG TTC GAG CAC TCA GGA

CTG TGG GTT TCT GTG CTG GCT GGT CTT CTG CTG GGA

GCC TGC CAG GCA CAC CCC ATC CCT GAC TCC AGT CCT

CTC CTG CAA TTC GGG GGC CAA GTC CGG CAG CGG TAC

CTC TAC ACA GAT GAT GCC CAG CAG ACA GAA GCC CAC

CTG GAG ATC AGG GAG GAT GGG ACG GTG GGG GGC GCT

GCT GAC CAG AGC CCC GAA AGT CTC CTG CAG CTG AAA

GCC TTG AAG CCG GGA GTT ATT CAA ATC TTG GGA GTC

AAG ACA TCC AGG TTC CTG TGC CAG CGG CCA GAT GGG

GCC CTG TAT GGA TCG CTC CAC TTT GAC CCT GAG GCC

TGC AGC TTC CGG GAG CTG CTT CTT GAG GAC GGA TAC

AAT GTT TAC CAG TCC GAA GCC CAC GGC CTC CCG CTG

CAC CTG CCA GGG AAC AAG TCC CCA CAC CGG GAC CCT

GCA CCC CGA GGA CCA GCT CGC TTC CTG CCA CTA CCA

GGC CTG CCC CCC GCA CCC CCG GAG CCA CCC GGA ATC

CTG GCC CCC CAG CCC CCC GAT GTG GGC TCC TCG GAC

CCT CTG AGC ATG GTG GGA CCT TCC CAG GGC CGA AGC

CCC AGC TAC GCT TCC TGA
```

The amino acid sequence of full length FGF21 is provided; the amino acids that make up the signal sequence are underlined:

```
                                              (SEQ ID NO: 32)
M D S D E T G F E H S G L W V S V L A G L L L G

A C Q A H P I P D S S P L L Q F G G Q V R Q R Y

L Y T D D A Q Q T E A H L E I R E D G T V G G A

A D Q S P E S L L Q L K A L K P G V I Q I L G V

K T S R F L C Q R P D G A L Y G S L H F D P E A

C S F R E L L L E D G Y N V Y Q S E A H G L P L

H L P G N K S P H R D P A P R G P A R F L P L P

G L P P A P P E P P G I L A P Q P P D V G S S D

P L S M V G P S Q G R S P S Y A S
```

The present disclosure provides binding proteins that are not expressed in non-recombinant organisms and which bind to FGFR1c, β-Klotho, or both FGFR1c and β-Klotho. In vivo, FGFR1c and β-Klotho associate with FGF21 to form a signaling complex. See FIG. 1, diagram A. Some binding proteins that bind to both FGFR1c and β-Klotho can mimic FGF21's in vivo signaling activity by localizing FGFR1c and β-Klotho, and can therefore take the place of FGF21 in the signaling complex. See FIG. 1, diagram B. Such binding proteins are disclosed herein.

Generally, the binding proteins of the present disclosure comprise one or more monomer domains that bind to FGFR1c, β-Klotho, or both FGFR1c and β-Klotho. These domains can be readily identified using a variety of polypeptide scaffolds to generate a plurality of polypeptide variants and then selecting a variant that binds to FGFR1c, β-Klotho or both FGFR1c and β-Klotho. The present disclosure therefore also provides methods for selecting a protein that binds to FGFR1c, β-Klotho, or both FGFR1c and β-Klotho. Proteins that bind both FGFR1c and β-Klotho are useful for a variety of purposes, including, e.g., for treating, metabolic disorders, such as diabetes, obesity, dyslipidimia, hypertension, hepatosteaotosis, non-alcoholic steatohepatitis (NASH), acute pancreatitis, cardiovascular disease, such as atherosclerosis, and aging. The polypeptides disclosed herein are also useful to detect and quantify FGFR1c and/or β-Klotho in a sample.

The amino acid sequences of human FGFR1c (SEQ ID NO: 33) and human β-Klotho (SEQ ID NO: 34) are known and are provided:

Human FGFR1c

```
                                              (SEQ ID NO: 33)
MWSWKCLLFWAVLVTATLCTARPSPTLPEQAQPWGAPVEVESFLVHPG
DLLQLRCRLRDDVQSINWLRDGVQLAESNRTRITGEEVEVQDSVPADS
GLYACVTSSPSGSDTTYFSVNVSDALPSSEDDDDDDDSSSEEKETDNT
KPNPVAPYWTSPEKMEKKLHAVPAAKTVKFKCPSSGTPNPTLRWLKNG
KEFKPDHRIGGYKVRYATWSIIMDSVVPSDKGNYTCIVENEYGSINHT
YQLDVVERSPHRPILQAGLPANKTVALGSNVEFMCKVYSDPQPHIQWL
KHIEVNGSKIGPDNLPYVQILKTAGVNTTDKEMEVLHLRNVSFEDAGE
YTCLAGNSIGLSHHSAWLTVLEALEERPAVMTSPLYLEIIIYCTGAFL
ISCMVGSVIVYKMKSGTKKSDFHSQMAVHKLAKSIPLRRQVTVSADSS
ASMNSGVLLVRPSRLSSSGTPMLAGVSEYELPEDPRWELPRDRLVLGK
PLGEGCFGQVVLAEAIGLDKDKPNRVTKVAVKMLKSDATEKDLSDLIS
EMEMMKMIGKHKNIINLLGACTQDGPLYVIVEYASKGNLREYLQARRP
PGLEYCYNPSHNPEEQLSSKDLVSCAYQVARGMEYLASKKCIHRDLAA
RNVLVTEDNVMKIADFGLARDIHHIDYYKKTTNGRLPVKWMAPEALFD
RIYTHQSDVWSFGVLLWEIFTLGGSPYPGVPVEELFKLLKEGHRMDKP
SNCTNELYMMMRDCWHAVPSQRPTFKQLVEDLDRIVALTSNQEYLDLS
MPLDQYSPSFPDTRSSTCSSGEDSVFSHEPLPEEPCLPRHPAQLANGG
LKRR
```

-continued

Human β-Klotho
(SEQ ID NO: 34)
MKPGCAAGSPGNEWIFFSTDEITTRYRNTMSNGGLQRSVILSALILLR
AVTGFSGDGRAIWSKNPNFTPVNESQLFLYDTFPKNFFWGIGTGALQV
EGSWKKDGKGPSIWDHFIHTHLKNVSSTNGSSDSYIFLEKDLSALDFI
GVSFYQFSISWPRLFPDGIVTVANAKGLQYYSTLLDALVLRNIEPIVT
LYHWDLPLALQEKYGGWKNDTIIDIFNDYATYCFQMFGDRVKYWITIH
NPYLVAWHGYGTGMHAPGEKGNLAAVYTVGHNLIKAHSKVWHNYNTHF
RPHQKGWLSITLGSHWIEPNRSENTMDIFKCQQSMVSVLGWFANPIHG
DGDYPEGMRKKLFSVLPIFSEAEKHEMRGTADFFAFSFGPNNFKPLNT
MAKMGQNVSLNLREALNWIKLEYNNPRILIAENGWFTDSRVKTEDTTA
IYMMKNFLSQVLQAIRLDEIRVFGYTAWSLLDGFEWQDAYTIRRGLFY
VDFNSKQKERKPKSSAHYYKQIIRENGFSLKESTPDVQGQFPCDFSWG
VTESVLKPESVASSPQFSDPHLYVWNATGNRLLHRVEGVRLKTRPAQC
TDFVNIKKQLEMLARMKVTHYRFALDWASVLPTGNLSAVNRQALRYYR
CVVSEGLKLGISAMVTLYYPTHAHLGLPEPLLHADGWLNPSTAEAFQA
YAGLCFQELGDLVKLWITINEPNRLSDIYNRSGNDTYGAAHNLLVAHA
LAWRLYDRQFRPSQRGAVSLSLHADWAEPANPYADSHWRAAERFLQFE
IAWFAEPLFKTGDYPAAMREYIASKHRRGLSSSALPRLTEAERRLLKG
TVDFCALNHFTTRFVMHEQLAGSRYDSDRDIQFLQDITRLSSPTRLAV
IPWGVRKLLRWVRRNYGDMDIYITASGIDDQALEDDRLRKYYLGKYLQ
EVLKAYLIDKVRIKGYYAFKLAEEKSKPRFGFFTSDFKAKSSIQFYNK
VISSRGFPFENSSSRESQTQENTECTVCLFLVQKKPLIFLGCCFFSTL
VLLLSIAIFQRQKRRKFWKAKNLQHIPLKKGKRVVS While the present disclosure provides for binding proteins comprising various single domains associated by linkers and other sequences, multimers of the domains can also be synthesized and used. In some embodiments, some (or optionally all, in some embodiments) of the domains of a binding protein bind FGFR1c, β-Klotho, or both FGFR1c and β-Klotho. In some of these embodiments, two or more of the domains are identical and bind to the same portion of a target protein, such as FGFR1c and/or β-Klotho. In other embodiments, at least some of the domains in the multimer bind to different portions of FGFR1c and/or β-Klotho. In yet other embodiments, at least some of the domains of a binding protein bind to a molecule or molecules other than FGFR1c or β-Klotho (e.g., a blood factor such as serum albumin, an immunoglobulin, or to erythrocytes).

II. General Discussion of Monomer Domains

The binding proteins disclosed herein comprise one or more monomer domains. Monomer domains that are particularly suitable for generating the binding proteins of the present disclosure are cysteine-rich domains comprising disulfide bonds. Cysteine-rich domains that form elements of the binding proteins disclosed herein typically do not form an α helix, a βsheet, or a β-barrel structure. Typically, the disulfide bonds promote folding of the domain into a three-dimensional structure. Usually, cysteine-rich domains have at least two disulfide bonds, more typically at least three disulfide bonds. In some embodiments, at least 5, 10, 15 or 20% of the amino acids in a monomer domain are cysteines.

Monomer domains can have any number of characteristics. For example, in some embodiments, the domains have low or no immunogenicity in an animal (e.g., a human). Monomer domains can also have a small size. In some embodiments, the domains are small enough to penetrate skin or other tissues. Additionally, monomer domains can have a range of in vivo half-lives or stabilities.

Illustrative monomer domains suitable for use in the binding proteins disclosed herein include, e.g., an EGF-like domain, a Kringle-domain, a fibronectin type I domain, a fibronectin type II domain, a fibronectin type III domain, a PAN domain, a Gla domain, a SRCR domain, a Kunitz/Bovine pancreatic trypsin Inhibitor domain, a Kazal-type serine protease inhibitor domain, a Trefoil (P-type) domain, a von Willebrand factor type C domain, an Anaphylatoxin-like domain, a CUB domain, a thyroglobulin type I repeat, LDL-receptor class A domain, a Sushi domain, a Link domain, a Thrombospondin type I domain, an Immunoglobulin-like domain, a C-type lectin domain, a MAM domain, a von Willebrand factor type A domain, a Somatomedin B domain, a WAP-type four disulfide core domain, a F5/8 type C domain, a Hemopexin domain, an SH2 domain, an SH3 domain, a Laminin-type EGF-like domain, a C2 domain, and other such domains known to those of ordinary skill in the art, as well as derivatives and/or variants thereof FIG. 2 schematically diagrams various kinds of monomer domains found in molecules in the LDL-receptor family.

In some embodiments, suitable monomer domains (e.g., domains with the ability to fold independently or with some limited assistance) can be selected from the families of protein domains that contain β-sandwich or β-barrel three dimensional structures as defined by such computational sequence analysis tools as Simple Modular Architecture Research Tool (SMART), see Shultz et al., *SMART: a web-based tool for the study of genetically mobile domains*, (2000) *Nucleic Acids Research* 28(1):231-234) or CATH (see Pearl et. al., *Assigning genomic sequences to CATH*, (2000) *Nucleic Acids Research* 28(1):277-282).

In another embodiment, monomer domains of the disclosed binding proteins include domains other than a fibronectin type III domain, an anticalin domain and a Ig-like domain from CTLA-4. Some aspects of these domains are described in WO01/64942, WO99/16873 and WO 00/60070.

As described herein, monomer domains can be cysteine rich. Suitable cysteine rich monomer domains include, e.g., the LDL receptor class A domain ("A-domain") or the EGF domain. The monomer domains can also have a cluster of negatively charged residues. FIG. 3A shows an example of an A-domain.

As described herein, monomer domains can be selected for the ability to bind to a target other than the target that a homologous naturally occurring domain may bind. Thus, in some embodiments, monomer domains (and multimers comprising such monomers) are provided that do not bind to the target or the class or family of target proteins that a substantially identical naturally-occurring monomer domain may bind.

Characteristics of a monomer domain can include the ability to fold independently and the ability to form a stable structure. Thus, the structure of the monomer domain is often conserved, although the polynucleotide sequence encoding the monomer need not be conserved. For example, the A-domain structure is conserved among the members of the A-domain family, while the A-domain nucleic acid sequence is not. Thus, for example, a monomer domain is classified as an A-domain by its cysteine residues and its affinity for calcium, not necessarily by its nucleic acid sequence. See FIG. 3B.

Specifically, the A-domains (sometimes called "complement-type repeats" or "LDL receptor type or class A domains") contain about 30-50 or 30-65 amino acids. In some embodiments, the domains comprise about 35-45 amino acids and in some cases about 35-40 amino acids. Within the 30-50 amino acids, there are about 6 cysteine residues. Of the six cysteines, disulfide bonds typically are found between the following cysteines: C1 and C3, C2 and C5, C4 and C6. The cysteine residues of the domain are disulfide linked to form a compact, stable, functionally independent moiety. See FIG. 3B. Clusters of these repeats make up a ligand binding domain, and differential clustering can impart specificity with respect to the ligand binding. FIG. 4 presents an exemplary list of various ligands that are recognized by the LDL-receptor family members.

One typical consensus sequence useful to identify A domains is the following: C-[VILMA]-$X_{(5)}$-C-[DNH]-$X_{(3)}$-[DENQHT]-C-$X_{(3,4)}$-[STADE]-[DEH]-[DE]-$X_{(1,5)}$-C (SEQ ID NO: 35). Consistent with the definition provided hereinabove, the residues in brackets indicate possible residues at one position. "$X_{(\#)}$" indicates number of residues. These residues can be any amino acid residue. Parentheticals containing two numbers refers to the range of amino acids that can occupy that position (e.g., "[DE]-$X_{(1,5)}$-C" (SEQ ID NO: 36) means that the amino acids DE are followed by 1, 2, 3, 4, or 5 residues, followed by cysteine, "C"). This consensus sequence only represents the portion of the A domain beginning at the third cysteine. A second consensus is as follows: C-$X_{(3-15)}$-C-$X_{(4-15)}$-C-$X_{(6-7)}$-C-[N,D]-$X_{(3)}$-[D,E,N,Q,H,S,T]-C-$X_{(4-6)}$-D-E-$X_{(2-8)}$-C (SEQ ID NO: 37). The second consensus predicts amino acid residues spanning all six cysteine residues. In some embodiments, A domain variants comprise sequences substantially identical to any of the above-described sequences. Note that reference to "LDL receptor class A" domain, for the purposes of the present disclosure, is not intended to indicate origin or binding properties of the domain.

Additional exemplary A domains include the following sequence:

$$C_aX_{3-15}C_bX_{3-15}C_cX_{6-7}C_d(D, N)X_4C_eX_{4-6}DEX_{2-8}C_f$$ (SEQ ID NO: 38)

wherein C is cysteine, $X_{n-m}$ represents between n and m number of independently selected amino acids, and (D,N) indicates that the position can be either D or N; and wherein $C_a$-$C_c$, $C_b$-$C_e$ and $C_d$-$C_f$ form disulfide bonds.

To date, at least 290 naturally-occurring human A-domains have been identified based on cDNA sequences. See FIGS. 5A-5H. Exemplary proteins containing naturally-occurring A-domains include, e.g., complement components (e.g., C6, C7, C8, C9, and Factor I), serine proteases (e.g., enteropeptidase, matriptase, and corin), transmembrane proteins (e.g., ST7, LRP3, LRP5 and LRP6) and endocytic receptors (e.g., Sortilin-related receptor, LDL-receptor, VLDLR, LRP1, LRP2, and ApoER2). A domains and A domain variants can function as monomer domains and variants thereof in the binding proteins disclosed herein. Further description of A domains can be found in the following publications and references cited therein: Howell and Hertz, *The LDL receptor gene family: signaling functions during development*, (2001) *Current Opinion in Neurobiology* 11:74-81; Krieger, *The "best" of cholesterols, the "worst" of cholesterols: A tale of two receptors*, (1998) *PNAS* 95: 4077-4080; Goldstein and Brown, *The Cholesterol Quartet*, (2001) *Science*, 292: 1310-1312; and, Moestrup and Verroust, *Megalin-and Cubilin-Mediated Endocytosis of Protein-Bound Vitamins, Lipids, and Hormones in Polarized Epithelia*, (2001) *Ann. Rev. Nutr.* 21:407-28.

A number of other domain types can also be used to generate FGFR1c and/or β-Klotho-binding monomer domains. Exemplary EGF monomer domains include the sequence:

$$C_aX_{3-14}C_bX_{3-7}C_cX_{4-16}C_dX_{1-2}C_eX_{8-23}C_f$$ (SEQ ID NO: 39)

wherein C is cysteine, $X_{n-m}$ represents between n and m number of independently selected amino acids; and wherein $C_a$-$C_c$, $C_b$-$C_e$ and $C_d$-$C_f$ form disulfide bonds.

Each of the domains described herein employ exemplary motifs (i.e., scaffolds). Certain positions are marked x, indicating that any amino acid can occupy the position. These positions can include a number of different amino acid possibilities, thereby allowing for sequence diversity and thus affinity for different target molecules. Use of brackets in motifs indicates alternate possible amino acids within a position (e.g., "[ekq]" indicates that either E, K or Q can be at that position). As used herein, use of parentheses in a sequence motif indicates that the positions within the parentheses can be present or absent (e.g., "([ekq])" indicates that the position is absent or either E, K, or Q can be at that position). When more than one "x" is used in parentheses (e.g., "(xx)"), each x represents a possible position. Thus "(xx)" indicates that zero, one or two amino acids can be at that position(s), where each amino acid is independently selected from any amino acid. Absent amino acids can also be designated by "–." α represents an aromatic/hydrophobic amino acid such as, e.g., W, Y, F, or L; β represents a hydrophobic amino acid such as, e.g., V, I, L, A, M, or F; x represents a smaller polar amino acid such as, e.g., G, A, S, or T; δ represents a charged amino acid such as, e.g., K, R, E, Q, or D; ε represents a small amino acid such as, e.g.; V, A, S, or T; and φ represents a negatively charged amino acid such as, e.g., D, E, or N.

Suitable domains include, e.g. thrombospondin type 1 domains, trefoil domains, and thyroglobulin domains.

Thrombospondin type 1 ("TSP1") domains contain about 30-50 or 30-65 amino acids. In some embodiments, the domains comprise about 35-55 amino acids and in some cases about 50 amino acids. Within the 35-55 amino acids, there are typically about 4 to about 6 cysteine residues. Of the six cysteines, disulfide bonds typically are found between the following cysteines: C1 and C5, C2 and C6, C3 and C4. The cysteine residues of the domain are disulfide linked to form a compact, stable, functionally independent moiety comprising distorted beta strands. Clusters of these repeats make up a ligand binding domain, and differential clustering can impart specificity with respect to the ligand binding.

Exemplary TSP1 domain sequences and consensus sequences are as follows (SEQ ID NOS 40-45, respectively, in order of appearance):

(1)
(SEQ ID NO: 40)
(xxxxxx) $C_1$xxx$C_2$xxxxx (x) xxxxx$C_3$xxxx (xxx) xxxxx$C_4$xxxxxx (x) xxx$C_5$ (x) xxxx$C_6$;

(2)
(SEQ ID NO: 41)
(WxxWxx) $C_1$xxx$C_2$xxGxx (x) xRxxx$C_3$xxxx (Pxx) xxxxx$C_4$xxxxxx (x) xxx$C_5$ (x) xxxx$C_6$;

(3)
(SEQ ID NO: 42)
(WxxWxx) $C_1$SXT$C_2$xxGxx (x) xRxRx$C_3$xxxx (Pxx) xxxxx$C_4$xxxxxx (x) xxx$C_5$ (x) xxxx$C_6$;

(4)
(SEQ ID NO: 43)
(WxxWxx) $C_1$[STND][VKAQ][TSPL]$C_2$xx[GQ]xx (x) x[RE]x [RKTVM]x[$C_3$VLDR]xxxx ([PQ]xx) xxxxx[$C_4$LDAE]xxxxxx (x) xxx$C_5$ (x) xxxx$C_6$;

(5)
(SEQ ID NO: 44)
(WxxWxx) $C_1$[STND][VKAQ][TSPL]$C_2$xx[GQ]xx (x) x[RE]x [RKTVM]x[$C_3$VLDR]xxxx ([PQ]xx) xxxxx[$C_4$LDAE]xxxxxx (x) xxx$C_5$ (x) xxxx$C_6$;
and (6)
(SEQ ID NO: 45)
$C_1$[NST][AEGIKLQRSTV][ADENPQRST]$C_2$[ADETGS]xGx [IKQRSTV]x[AQRSTx]x[ALMRTV]x$C_3$xxxxxxxxx (xxxxxxx) $C_4$xxxxxxxxx (xx) $C_5$xxxx$C_6$;

In some embodiments, thrombospondin type 1 domain variants comprise sequences substantially identical to any of the above-described sequences.

To date, at least 1677 naturally occurring thrombospondin domains have identified based on cDNA sequences. Exemplary proteins containing the naturally occurring thrombospondin domains include, e.g., proteins in the complement pathway (e.g., properdin, C6, C7, C8A, C8B, and C9), extracellular matrix proteins (e.g., mindin, F-spondin, SCO-spondin,), circumsporozoite surface protein 2, and TRAP proteins of *Plasmodium*. Thrombospondin type 1 domains are further described in, e.g., Roszmusz et al., *BBRC* 296:156 (2002); Higgins et al., *J Immunol*. 155:5777-85 (1995); Schultz-Cherry et al., *J. Biol. Chem*. 270:7304-7310 (1995); Schultz-Cherry et al., *J. Biol. Chem*. 269:26783-8 (1994); Bork, *FEBS Lett* 327:125-30 (1993); and Leung-Hagesteijn et al., *Cell* 71:289-99 (1992).

Another exemplary monomer domain suitable for use in generating the binding proteins of the present disclosure is the trefoil domain. Trefoil monomer domains are typically about 30-50 or 30-65 amino acids. In some embodiments, the domains comprise about 35-55 amino acids and in some cases about 45 amino acids. Within the 35-55 amino acids, there are typically about 6 cysteine residues. Of the six cysteines, disulfide bonds typically are found between the following cysteines: C1 and C5, C2 and C4, C3 and C6.

At least 149 naturally occurring trefoil domains have identified based on cDNA sequences. Exemplary proteins containing naturally occurring trefoil domains include, e.g., protein pS2 (TFF1), spasmolytic peptide SP (TFF2), intestinal trefoil factor (TFF3), intestinal surcease-isomaltase, and proteins which may be involved in defense against microbial infections by protecting the epithelia (e.g., *Xenopus* xP1, xP4, integumentary mucins A.1 and C.1. Trefoil domains are further described in, e.g., Sands and Podolsky, *Annu. Rev. Physiol*. 58:253-273 (1996); Carr et al., *PNAS USA* 91:2206-2210 (1994); DeA et al., *PNAS USA* 91:1084-1088 (1994); Hoffman et al., *Trends Biochem Sci* 18:239-243 (1993).

Exemplary trefoil domain sequences and consensus sequences are as follows (SEQ ID NOS 46-51, respectively, in order of appearance):

(1)
(SEQ ID NO: 46)
C$_1$(xx)xxxxxxxxxC$_2$xx(x)xxxxxxxC$_3$xxxxC$_4$C$_5$xxxxx(x)xxxxxC$_6$;

(2)
(SEQ ID NO: 47)
C$_1$(xx)xxxxxxRxxC$_2$xx(x)xxxxxxxC$_3$xxxxC$_4$C$_5$xxxxx(x)xxxxxC$_6$;

(3)
(SEQ ID NO: 48)
C$_1$(xx)xxxpxxRxNC$_2$Gx(x)PXITxxxC$_3$xxxgC$_4$C$_5$FDxxx(x)xxxPWC$_6$F;

(4)
(SEQ ID NO: 49)
C$_1$(xx)xxx[PVAE]xxRx[NDPM]C$_2$[GAIY][YPFST]([DE]x)[PSKQ]x[IVAP][TSA]xx[QEDK]C$_3$xx[KRLN][GNK]C$_4$C$_5$[FWY][DNRS][SDPNTE]xx(x)xxx[PKI][WEASH]C$_6$[FY];

(5)
(SEQ ID NO: 50)
C$_1$(xx)xxx[PVAE]xxRx[NDPM]C$_2$[GAIY][YPFST]([DE]x)[PSKQ]x[IVAP][TSA]xx[KEQD]C$_3$xx[KRLN][GNK]C$_4$C$_5$[α][DNRS][SDPNTE]xx(x)xxx[PKI][WEASH]C$_6$[FY];

(6)
(SEQ ID NO: 51)
C$_1$([DNPS][ADIKLNPRSTV][DFILMV][ADENPRST][ADELPRV][EHKLNQRS][ADEGKNSV][KQR][FIKLQRTV][DNPQS]C$_2$[AGIY][FLPSVY][DKNPQS][ADFGHLP][AIPV][ST]
[AEGKPQRS][ADEGKPQS][DEIKNQT]C$_3$[ADEFKNQRT][ADEGKNQS][GN]C$_4$C$_5$[WYFH][DEINRS][ADGNPST][AEFGQLRSTW][GIKNSVMQ]([AFMPRSTV][DEGKLNS][AFIQSTV][IKNPV]W)C$_6$.

Yet another exemplary monomer domain suitable for use in generating the binding proteins of the present disclosure is the thyroglobulin domain. Thyroglobulin monomer domains are typically about 30-85 or 30-80 amino acids. In some embodiments, the domains comprise about 35-75 amino acids and in some cases about 65 amino acids. Within the 35-75 amino acids, there are typically about 6 cysteine residues. Of the six cysteines, disulfide bonds typically are found between the following cysteines: C1 and C2, C3 and C4, C5 and C6.

At least 251 naturally occurring thyroglobulin domains have been identified based on cDNA sequences. The N-terminal section of Tg contains 10 repeats of a domain of about 65 amino acids which is known as the Tg type-1 repeat. See, e.g., Malthiéry Y, Lissitzky S., *Eur J Biochem*. (1987) 165(3): 491-8; Molina et al., *Eur. J. Biochem*. 240:125-133 (1996). Exemplary proteins containing naturally occurring thyroglobulin domains include e.g., the HLA class II associated invariant chain, human pancreatic carcinoma marker proteins, nidogen (entactin), insulin-like growth factor binding proteins (IGFBP), saxiphilin, chum salmon egg cysteine proteinase inhibitor, and equistatin. The Thyr-1 and related domains belong to MEROPS proteinase inhibitor family 131, clan IX. Thyroglobulin domains are further described in, e.g., Molina et al., *Eur. J. Biochem*. 240:125-133 (1996); Guncar et al., *EMBO J* 18:793-803 (1999); Chong and Speicher, *DW* 276:5804-5813 (2001).

Exemplary thyroglobulin domain sequences and consensus sequences are as follows (SEQ ID NOS 52-56, respectively, in order of appearance):

(1)
(SEQ ID NO: 52)
C$_1$xxxxxxxxxxxxxxx(xxxxxxxxxx)xxxxxxxxxxC$_2$xxxxxxxxxxC$_3$x(x)x(xxx)xxxxC$_4$xC$_5$xxxxx(x)xxxxxxxxxxxxx(xx)xC$_6$;

(2)
(SEQ ID NO: 53)
C$_1$xxxxxxxxxxxxxxx(xxxxxxxxxx)xxxxxxxYxPxC$_2$xxxGxxxxxQC$_3$x(x)x(xxx)xxxxC$_4$WC$_5$Vxxx(x)GxxxxGxxxxxxxx(xx)xC$_6$;

(3)
(SEQ ID NO: 54)
C$_1$xxxxxxxxxxxxxxx(xxxxxxxxxx)xxxxxxxyxPxC$_2$xxxGxyxxxQC$_3$x(x)S(xxx)xxGxC$_4$WC$_5$VDxx(x)GxxxxGxxxxxgxx(xx)xC$_6$;

(4)
(SEQ ID NO: 55)
C$_1$[QERL]xxxxxxxxxxxxxxx(xxxxxxxxxx)xxxxxxx[YFHP]xPxC$_2$xxxGx[YF]xx[VKRL]QC$_3$x(x[SA]xxx)xx[GSA]xC$_4$[WYF]C$_5$V[DNYFL]xx(x)Gxxxx[GDNE]xxxxxGxx(xx)xC$_6$;

(5)
(SEQ ID NO: 56)
C$_1$[QERL]xxxxxxxxxxxxxxx(xxxxxxxxxx)xxxxxxx[αHP]xPxC2xxxGx[α]xx[VKRL]QC$_3$x(x[SA]xxx)xx[GAS]xC$_4$[α]C$_5$V[DNα]xx(x)Gxxxx[φG]xxxxxGxx(xx)xC$_6$;

Still another exemplary monomer domain that can be used in generating the binding proteins of the present disclosure is a laminin-EGF domain. Laminin-EGF domains are typically about 30-85 or 30-80 amino acids. In some embodiments, the domains comprise about 45-65 amino acids and in some cases about 50 amino acids. Within the 45-65 amino acids, there are typically about 8 cysteine residues which interact to form 4 disulfide bonds. Laminins are a major noncollagenous component of basement membranes that mediate cell adhesion, growth migration, and differentiation. They are composed of distinct but related alpha, beta, and gamma chains. The three chains form a cross-shaped molecule that consists of a long arm and three short globular arms. The long arm consists of a coiled coil structure contributed by all three chains and cross-linked by interchain disulfide bonds.

Exemplary laminin EGF domain sequences and consensus sequences are as follows (SEQ ID NOS 57-59, respectively, in order of appearance):

(1)
(SEQ ID NO: 57)
$C_1xC_2xxxxxxx(xxx)xxC_3xxx(xxxxxx)xxxxC_4xC_5xxxxxxxxxC_6$
$xxC_7xxxxxxxx(xxxxx)xxxxxC_8$ (2)
(SEQ ID NO: 58)
$C_1xC_2xxxxxxx(xxx)xxC_3xxx(xxxxxx)xxgxC_4xC_5xxxxxGxx$
$C_6xxC_7xxxxxxxx(xxxxx)xxxxxC_8$ (3)
(SEQ ID NO: 59)
$C_1xC_2[NDH]xxxxxx(xxx)xxC_3xxx(xxxxxx)xxGxC_4xC_5xxxxx$
$GxxC_6[DENQ]xC_7xx[GN][YFHT]xxx(xxxxx)xxxxxC_8$ In some embodiments, the monomer domain is a Notch/LNR monomer domain, a DSL monomer domain, an Anato monomer domain, an integrin beta monomer domain, and a Ca-EGF monomer domain.

In some embodiments, the Ca-EGF monomer domain comprises the following sequence (SEQ ID NO: 60):

$DxDEC_1xx(xx)xxxxxC_2x(xx)xxxxxxC_3xNxxGxFxC_4x(xxx)$
$xC_5xxgxxxxxxxx(xxxxx)xxxC_6$.

In some embodiments, the Notch/LNR monomer domain, comprises the following sequence (SEQ ID NO: 61): $C_1xx(xx)xxxC_2xxxxxNGxC_3xxxC_4NxxxC_5xxDGxDC_6$ In some embodiments, the DSL monomer domain comprises the following sequence:

(SEQ ID NO: 62)
$C_1xxxxYYGxxC_2xxFC_3xxxxxDxxxHxxC_4xxxGxxxC_5xxGWxGxxC_6$.

Anato monomer domain comprises the following sequence (SEQ ID NO: 63):

$C_1C_2xDGxxxxx(x)xxxxxC_3exrxxxxxx(xx)xxC_4xxxFxxC_5C_6$.

In some embodiments, the integrin beta monomer domain comprises the following sequence (SEQ ID NO: 1240):
$C_1xxC_2xxxxpxC_3xWC4xxxxxFxxx(Gx)$
$xxxxRC_5DxxxxLxxxgC_6$; and "x" is any amino acid.

In some embodiments, $C_1$-$C_5$, $C_2$-$C_4$ and $C_3$-$C_6$ of the Notch/LNR monomer domain form disulfide bonds; and $C_1$-$C_5$, $C_2$-$C_4$ and $C_3$-$C_6$ of the DSL monomer domain form disulfide bonds.

In some embodiments, the Ca-EGF monomer domain comprises the following sequence:

(SEQ ID NO: 64)
$D[\beta][DN]EC_1xx(xx)xxxxxC_2[PDG](Dx)xxxxxxC_3xNxxG[SGT]$
$[\alpha]xC_4x(xxx)xC_5xx[GSN][\alpha S]xxxxxx(xxxxx)xxxC_6$.

In some embodiments, the Notch/LNR monomer domain, comprises the following sequence:

(SEQ ID NO: 65)
$C_1xx(x[\beta\alpha])xxxC_2x[\phi s]xxx[\phi][GK]xC_3[ND]x[\phi SA]C_4[\phi S]$
$xx[aeg]C_5x[\alpha]DGxDC_6$.

In some embodiments, the DSL monomer domain comprises the following sequence:

(SEQ ID NO: 66)
$C_1xxx[\alpha][\alpha H][GSNA]xxC_2xx[\alpha]C_3x[PAE]xx[DA]xx[\chi L]$
$[HRGK][\alpha K]xC_4[DNSG]xxGxxxC_5xxG[\alpha]xGxxC_6$.

In some embodiments, the Anato monomer domain comprises the following sequence:

(SEQ ID NO: 67)
$C_1C_2x[DHTL][GA]xxxx[PLANT](xx)xxxxxC_3[ESQDA]x$
$[RLPS]xxxxxx([GEPA]x)xxC_4xx[AVFPT][FQVY]xxC_5C_6$.

In some embodiments, the integrin beta monomer domain comprises the following sequence:
$C_1 xxC_2[\beta]xx[GHDS][PK]xC_3[\chi][\alpha]C_4xxxx[\alpha]xxx([GR]xx)x[\chi]xRC_5[DNAE]xxxxL[\beta K]xx[GN]C_6$ (SEQ ID NO: 68); α is selected from: W, Y, F, and L; β is selected from: V, I, L, A, M, and F; χ is selected from: G, A, S, and T; δ is selected from: K, R, E, Q, and D; ε is selected from: V, A, S, AND T; and φ is selected from: D, E, and N.

In some embodiments, the Ca-EGF monomer domain comprises the following sequence:

(SEQ ID NO: 69)
$D[VILF][DN]EC_1xx(xx)xxxxxC_2[PDG](Dx)xxxxxxC_3xNxxG$
$[SGT][FY]xC_4x(xxx)xC_5xx[GSN][\alpha S]xxxxxx(xxxxx)xxxC_6$.

In some embodiments, the Notch/LNR monomer domain, comprises the following sequence:

(SEQ ID NO: 70)
$C_1xx(x[YIFLV])xxxC_2x[DENS]xxx[NDE][GK]xC_3[ND]x[DE$
$NSA]C_4[NSDE]xx[AEG]C_5x[WYF]DGxDC_6$.

In some embodiments, the DSL monomer domain comprises the following sequence:

(SEQ ID NO: 71)
$C_1xxx[YWF][YFH][GASN]xxC_2xx[FY]C_3x[PAE]xx[DA]xx[G$
$LAST][HRGK][YKFW]xC_4[DSGN]xxGxxxC_5xxG[WLFY]xGxx$
$C_6$.

In some embodiments, the Anato monomer domain comprises the following sequence:

(SEQ ID NO: 72)
$C_1C_2x[ADEHLT]gxxxxxxxxx(x)[DERST]C_3xxxxxxxxxx(xx[AE$
$RSV])C_4xx[APVT][FMQ][EKLQRTV][ADEHQRSK](x)C_5C_6$.

In some embodiments, the integrin beta monomer domain comprises the following sequence:

(SEQ ID NO: 73)

$C_1$[AEGKQRST][KREQD]$C_2$[IL][AELQRV][VILAS][DGHS][KP]x$C_3$[GAST][WY]$C_4$xxxx[FL]xxxx(xxxx[VILAR]R)$C_5$[AND][DILRT][IKLPQRV][ADEPS][AENQ]L[IKLQV]x[ADKNR][GN]$C_6$.

Polynucleotides encoding the monomer domains are typically employed to make monomer domains via expression. Nucleic acids that encode monomer domains can be derived from a variety of different sources. Libraries of monomer domains can be prepared by expressing a plurality of different nucleic acids encoding naturally occurring monomer domains, altered monomer domains (i.e., monomer domain variants), or a combinations thereof For example, libraries can be designed in which a scaffold of amino acids remain constant (e.g., an LDL A receptor domain, EGF domain) while the intervening amino acids in the scaffold comprise randomly generated amino acids.

Also provided herein are methods of identifying monomer domains that bind to a selected or desired ligand or mixture of ligands. In some embodiments, monomer domains are identified or selected for a desired property (e.g., binding affinity) and then the monomer domains are formed into multimers. See FIG. 6. For those embodiments, any method resulting in selection of domains with a desired property (e.g., a specific binding property) can be used. For example, the methods can comprise providing a plurality of different nucleic acids, each nucleic acid encoding a monomer domain; translating the plurality of different nucleic acids, thereby providing a plurality of different monomer domains; screening the plurality of different monomer domains for binding of the desired ligand or a mixture of ligands; and, identifying members of the plurality of different monomer domains that bind the desired ligand or mixture of ligands.

Monomer domains can be non-recombinant (e.g., isolated from a cell) or altered (e.g., recombinant variants). The term "non-recombinant" is used in this context to indicate that a protein sequence can be found in nature. For example, non-recombinant monomer domains can include human monomer domains or optionally, domains derived from different species or sources, e.g., mammals, primates, rodents, fish, birds, reptiles, plants, etc. Non-recombinant monomer domains can be obtained by a number of methods, e.g., by PCR amplification of genomic DNA or cDNA.

Monomer domains disclosed herein, whether an element of a binding protein or not, can be non-recombinant domains or recombinant variants. Libraries of monomer domains can contain non-recombinant monomer domain, recombinant monomer domain variants, or a combination thereof.

Monomer domain variants can include ancestral domains, chimeric domains, randomized domains, mutated domains, and the like. For example, ancestral domains can be based on phylogenetic analysis. Chimeric domains are domains in which one or more regions are replaced by corresponding regions from other domains of the same family. For example, chimeric domains can be constructed by combining loop sequences from multiple related domains of the same family to form novel domains with potentially lowered immunogenicity. Those of skill in the art will recognize the immunologic benefit of constructing modified binding domain monomers by combining loop regions from various related domains of the same family rather than creating random amino acid sequences. For example, by constructing variant domains by combining loop sequences or even multiple loop sequences that occur naturally in human LDL receptor class A-domains, the resulting domains may contain novel binding properties but may not contain any immunogenic protein sequences because all of the exposed loops are of human origin. The combining of loop amino acid sequences in endogenous context can be applied to all of the monomer constructs disclosed herein. Thus also provided is a method for generating a library of chimeric monomer domains derived from human proteins, the method comprising: providing loop sequences corresponding to at least one loop from each of at least two different naturally occurring variants of a human protein, wherein the loop sequences are polynucleotide or polypeptide sequences; and covalently combining loop sequences to generate a library of at least two different chimeric sequences, wherein each chimeric sequence encodes a chimeric monomer domain having at least two loops. Typically, a chimeric domain has at least four loops, and usually at least six loops. As described above, the present disclosure provides three types of loops that are identified by specific features, such as, potential for disulfide bonding, bridging between secondary protein structures, and molecular dynamics (i.e., flexibility). The three types of loop sequences are a cysteine-defined loop sequence, a structure-defined loop sequence, and a B-factor-defined loop sequence.

Randomized domains are domains in which one or more regions are randomized The randomization can be based on full randomization, or optionally, partial randomization based on natural distribution of sequence diversity.

The present disclosure also provides recombinant nucleic acids encoding one or more binding proteins comprising one or a plurality of monomer domains that bind FGFR1c or β-Klotho or both FGFR1c and β-Klotho. For example, the binding protein can be selected to comprise a non-recombinant domain from the group consisting of: an EGF-like domain, a Kringle-domain, a fibronectin type I domain, a fibronectin type II domain, a fibronectin type III domain, a PAN domain, a Gla domain, a SRCR domain, a Kunitz/Bovine pancreatic trypsin Inhibitor domain, a Kazal-type serine protease inhibitor domain, a Trefoil (P-type) domain, a von Willebrand factor type C domain, an Anaphylatoxin-like domain, a CUB domain, a thyroglobulin type I repeat, LDL-receptor class A domain, a Sushi domain, a Link domain, a Thrombospondin type I domain, an Immunoglobulin-like domain, a C-type lectin domain, a MAM domain, a von Willebrand factor type A domain, a Somatomedin B domain, a WAP-type four disulfide core domain, a F5/8 type C domain, a Hemopexin domain, an SH2 domain, an SH3 domain, a Laminin-type EGF-like domain, a C2 domain and variants of one or more thereof. In another embodiment, the naturally occurring polypeptide encodes a monomer domain found in the Pfam database and/or the SMART database.

All the compositions of the present disclosure, including the binding proteins produced by the methods disclosed herein and/or described herein, e.g., monomer domains, multimers and libraries thereof, can be optionally bound to a matrix of an affinity material. Examples of affinity material include beads, a column, a solid support, a microarray, other pools of reagent-supports, and the like.

Moreover, all of the binding proteins produced by the methods disclosed herein and/or described herein can optionally comprise non-naturally occurring amino acids. The term "non-naturally occurring amino acid" also includes, but is not limited to, amino acids that occur by modification (e.g., post-translational modifications) of a naturally encoded amino acid (including but not limited to, the 20 common amino acids) but are not themselves naturally incorporated into a growing polypeptide chain by the translation complex.

Examples of such non-naturally-occurring amino acids include, but are not limited to, N-acetylglucosaminyl-L-serine, -acetylglucosaminyl-L-threonine, O-phosphotyrosine, and those provided hereinabove.

III. Monomers of the Present Disclosure

The present disclosure provides binding proteins that comprise one or more monomers. In particular, methods, compositions and kits, as well as discrete monomer domains that bind to FGFR1c and/or β-Klotho, and which can form elements of a multimer (also known as a combinatorial mosaic protein or a recombinant mosaic protein) comprising two or more monomer domains that are joined via a linker are described. The multimers can be screened to identify those that have an improved phenotype such as improved avidity or affinity or altered specificity for the ligand or the mixture of ligands, compared to the discrete monomer domain; multimers identified using these and other approaches are provided.

Monomer domains can be of any size. In some embodiments, monomer domains have about 25 to about 500, about 30 to about 200, about 30 to about 100, about 35 to about 50, about 35 to about 100, about 90 to about 200, about 30 to about 250, about 30 to about 60, about 9 to about 150, about 100 to about 150, about 25 to about 50, or about 30 to about 150 amino acids. Similarly, a monomer domain can comprise, e.g., from about 30 to about 200 amino acids; from about 25 to about 180 amino acids; from about 40 to about 150 amino acids; from about 50 to about 130 amino acids; or from about 75 to about 125 amino acids. Monomer domains can typically maintain a stable conformation in solution, and are often heat stable, e.g., stable at 95° C. for at least 10 minutes without losing binding affinity. In some embodiments, monomer domains can fold independently into a stable conformation. In one embodiment, the stable conformation is stabilized by ions (e.g., such as metal or calcium ions). The stable conformation can optionally contain disulfide bonds (e.g., at least one, two, or three or more disulfide bonds). The disulfide bonds can optionally be formed between two cysteine residues. In some embodiments, monomer domains, or monomer domain variants, are substantially identical to the sequences exemplified.

As described herein, monomer domains can be cysteine rich. Suitable cysteine rich monomer domains include, e.g., the LDL receptor class A domain ("A-domain") or the EGF-like domain. The monomer domains can also have a cluster of negatively charged residues. Specifically, the A-domains (sometimes called "complement-type repeats") contain about 30-50 or 30-65 amino acids. In some embodiments, the domains comprise about 35-45 amino acids and in some cases about 40 amino acids. Within the 30-50 amino acids, there are an even number of cysteine residues, typically about 6 cysteine residues. Of the six cysteines, disulfide bonds typically are found between the following cysteines: C1 and C3, C2 and C5, C4 and C6. The A domain constitutes a ligand binding moiety. The cysteine residues of the domain are disulfide linked to form a compact, stable, functionally independent moiety. Clusters of these repeats make up a ligand binding domain, and differential clustering can impart specificity with respect to the ligand binding.

Other features of monomer domains include the ability to bind ligands (e.g., as in the LDL receptor class A domain, or the CUB domain (complement C1r/C1s, Uegf, and bone morphogenic protein-1 domain), the ability to participate in endocytosis or internalization (e.g., as in the cytoplasmic tail of the LDL receptor or the cytoplasmic tail of Megalin), the ability to bind an ion (e.g., $Ca^{2+}$ binding by the LDL receptor A-domain), and/or the ability to be involved in cell adhesion (e.g., as in the EGF-like domain). Other monomer domains that bind ions to maintain their secondary structure include, e.g., A domain, EGF domain, EF Hand (e.g., such as those found in present in calmodulin and troponin C), Cadherin domain, C-type lectin, C2 domain, Annexin, Gla-domain, Trombospondin type 3 domain, all of which bind calcium, and zinc fingers (e.g., C2H2 type C3HC4 type (RING finger), Integrase Zinc binding domain, PHD finger, GATA zinc finger, FYVE zinc finger, B-box zinc finger), which bind zinc.

Characteristics of a monomer domain include the ability to fold independently and the ability to form a stable structure. Thus, the structure of the monomer domain is often conserved, although the polynucleotide sequence encoding the monomer need not be conserved. For example, the A-domain structure is conserved among the members of the A-domain family, while the A-domain nucleic acid sequence is not. Thus, for example, a monomer domain is classified as an A-domain by its cysteine residues and its affinity for calcium, not necessarily by its nucleic acid sequence.

As described herein, monomer domains can be selected for the ability to bind to targets other than the target that a homologous naturally occurring domain can bind. Thus, in some embodiments, monomer domains (and multimers comprising such monomers) are provided that do not bind to the target or the class or family of target proteins that a homologous naturally occurring domain can bind.

III.A. FGFR1c Binding Proteins

In some aspects, monomer domains are provided that bind to (e.g., selectively bind) human FGFR1c or a portion thereof. A portion of FGFR1c can comprise, e.g., at least 5, 10, 15, 20, 30, 50, 100, or more contiguous amino acids of the polypeptide. In some embodiments, the monomers will bind to FGFR1c with a affinity stronger than $10^{-3}$ M (e.g., $10^{-4}$M, etc.). In some embodiments, the affinity is stronger than $10^{-4}$ M, $10^{-5}$ M, $10^{-6}$ M, $10^{-7}$ M, $10^{-8}$ M, $10^{-9}$ M or $10^{-10}$ M.

A large number of FGFR1c binding sequences having an A domain scaffold were generated. As described in detail in the Examples, three families (i.e., Families 1-3, or "Fam 1-3") of monomer domains that bind to FGFR1c were identified. The consensus motifs generated based on these families indicate common amino acid residues between the binders within the family.

III.A.1. Family 1 Sequences

Family 1 has the following consensus motif (SEQ ID NO: 74):

C[AGLQRV][ALPST][DGINRS][ELQ]F[PQT]C[GHKNQRS][DGN

S][GST][EGKNRS][IRST-]C[ILV][PS][LPQRV][AHKPQRT]W

[LRV]CDG[DEV][DNP]DC[EGR]D[DGNS]SDE[AEKST][DGNPS]

[AD-][IH-]C

Exemplary sequences comprising the FGFR1c Family 1 motif include the following sequences:

```
                                     (SEQ ID NO: 75)
     CASGQFQCSNGNCVPQHWVCDGDNDCEDNSDEEDC, (SEQ ID NO: 76)
     CASGQFTCRSTNICLSLAWLCDGDDDCEDNSDESPAIC, (SEQ ID NO: 77)
     CGAGLFTCRSTKICISQAWVCDGVDDCEDNSDEKNC, (SEQ ID NO: 78)
     CRSRQFQCKGSSTCIPVQWVCDGDNDCGDSSDEAGC,
```

-continued

```
                                         (SEQ ID NO: 79)
CGAGQFQCRSTNICISLKWVCDGVDDCEDNSDETSC, (SEQ ID NO: 80)
CGAGQFQCRSTNICVSLAWRCDGEDDCEDNSDETSC, (SEQ ID NO: 81)
CGAGQFTCNSTNICISPRWVCDGVNDCEDNSDEKNC, (SEQ ID NO: 82)
CGAGQFTCRDTNICISRAWRCDGVDDCEDNSDEADC, (SEQ ID NO: 83)
CGAGQFTCRSTKICISQAWVCDGVDDCEDNSDEAGC, (SEQ ID NO: 84)
CGAGQFTCRSTKICISQAWVCDGVDDCEDNSDEKNC, (SEQ ID NO: 85)
CGAGQFTCRSTKICISQAWVCDGVDDCEDNSDETSC, (SEQ ID NO: 86)
CGAGQFTCRSTNICLPLQWVCDGVDDCEDNSDEAGC, (SEQ ID NO: 87)
CGANQFTCHNTNICISLTWVCDGVDDCEDGSDESPDHC, (SEQ ID NO: 88)
CGANQFTCHNTNICISLTWVCDGVDDCEDNSDEAGC, (SEQ ID NO: 89)
CGANQFTCHNTNICISQAWVCDGVDDCEDNSDEKNC, (SEQ ID NO: 90)
CGARQFPCRGSRICISQPWVCDGDNDCEDNSDEKNC, (SEQ ID NO: 91)
CGPGQFTCQDTEICISQAWVCDGVDDCEDNSDEKNC, (SEQ ID NO: 92)
CGPIQFTCRNTNICLSVHWVCDGEDDCEDGSDEEGC, (SEQ ID NO: 93)
CGPNQFTCRSTNICLSQTWVCDGVDDCEDGSDETNC, (SEQ ID NO: 94)
CGPSQFTCRNTNICISLRWRCDGVDDCEDNSDEEGC, (SEQ ID NO: 95)
CGSNQFTCRSTNICISQAWVCDGVDDCEDDSDETGC, (SEQ ID NO: 96)
CGSSEFQCRNSRRCIPPAWVCDGDNDCGDSSDEKSC, (SEQ ID NO: 97)
CGSSQFTCHNTNICLPQAWVCDGVDDCEDNSDEKNC, (SEQ ID NO: 98)
CGSSQFTCHNTNICLPRARVCDGVDDCEDNSDEAGC, (SEQ ID NO: 99)
CGSSQFTCHNTNICLPRAWVCDGVDDCEDNSDEAGC, (SEQ ID NO: 100)
CGSSQFTCHNTNICLPRAWVCDGVDDCEDNSDEKNC, (SEQ ID NO: 101)
CGTGQFTCRSTKICISQAWVCDGVDDCEDNSDEKNC, (SEQ ID NO: 102)
CLSDQFTCRSTNICLPLQWVCDGDDDCEDNSDEEDC, (SEQ ID NO: 103)
CQSNEFQCRSTGRCISVAWVCDGEDDCRDSSDEADC, (SEQ ID NO: 104)
CRLNEFPCGSGSCISLHWVCDSVPDCRDDSDETDC, (SEQ ID NO: 105)
CVPGQFQCNNGNCIPVTWLCDGDNDCGDSSDEAPAHC, (SEQ ID NO: 106)
CVSGQFQCGNGNCIPQAWLCDGDNDCGDSSDEKDC,
and (SEQ ID NO: 107)
CVSGQFQCGNGNCIPRPWRCDGDNDCGDSSDETGC.
```

III.A.2. Family 2 Sequences

Family 2 has the following consensus motif (SEQ ID NO: 108):

CG[AE][GS]LFTC[GR][NRS][AST][KN]ICIS[EHQS][AV]W
[IV]CDG[IV]DDC[DE]DNSDE[DKMNT][NSY]C

Exemplary sequences comprising the FGFR1c Family 2 motif include the following sequences:

```
                                         (SEQ ID NO: 109)
CGAGLFTCRS TNICISQVWV CDGVDDCEDN SDEDSC, (SEQ ID NO: 110)
CGAGLFTCRS TNICISQAWV CDGVDDCEDN SDENYC, (SEQ ID NO: 111)
CGAGLFTCRS TNICISQAWV CDGVDDCEDN SDETNC, (SEQ ID NO: 112)
CGEGLFTCGS TNICISSAWV CDGVDDCEDN SDENNC, (SEQ ID NO: 113)
CGEGLFTCRS TNICISHAWV CDGVDDCEDN SDENNC, (SEQ ID NO: 114)
CGEGLFTCRS TNICISEAWI CDGVDDCEDN SDEKNC, (SEQ ID NO: 115)
CGAGLFTCRS AKICISHAWV CDGIDDCEDN SDENNC, (SEQ ID NO: 116)
CGAGLFTCRN SKICISQAWV CDGVDDCDDN SDEKYC, (SEQ ID NO: 117)
CGASLFTCRR SNICISQAWV CDGVDDCEDN SDEMNC,
and
                                         (SEQ ID NO: 118)
CGAGLFTCRS TKICISQAWV CDGVDDCEDN SDEKNC.
```

III.A.3. Family 3 Sequences

Family 3 has the following consensus motif (SEQ ID NO: 119):

CG[APST][DN][LMQ]FTC[QR][RS]TN[IM]CIS[DKPQR][ATV]

WVCDGVDDC[DE]D[DENY]SDE[IQRT][AGTV]C.

Exemplary sequences comprising the FGFR1c Family 3 motif include the following sequences:

```
                                         (SEQ ID NO: 120)
CGANLFTCQS TNICISDAWV CDGVDDCEDN SDETTC, (SEQ ID NO: 121)
CGTNMFTCQR TNICISDAWV CDGVDDCEDY SDETAC, (SEQ ID NO: 122)
CGTNLFTCRS TNMCISQAWV CDGVDDCEDN SDETVC, (SEQ ID NO: 123)
CGSNLFTCRR TNICISKAWV CDGVDDCEDN SDETGC,
```

```
                                      (SEQ ID NO: 124)
CGANLFTCRS TNICISPAWV CDGVDDCEDY SDEIGC, (SEQ ID NO: 125)
CGANLFTCRS TNICISPTWV CDGVDDCDDN SDEIGC, (SEQ ID NO: 126)
CGPNLFTCRS TNICISRAWV CDGVDDCDDE SDEQGC, (SEQ ID NO: 127)
CGSNLFTCRS TNICISPAWV CDGVDDCDDD SDETGC, (SEQ ID NO: 128)
CGSDMFTCRS TNICISKVWV CDGVDDCEDD SDERGC,
and (SEQ ID NO: 129)
CGSNQFTCRS TNICISQAWV CDGVDDCEDD SDETGC.
```

As described herein, monomer domains can be linked to form multimers that bind the same target (e.g., FGFR1c). The present disclosure provides polypeptides comprising both homo— (i.e., at least two identical monomers) and hetero— (i.e., different monomers that bind the same target) multimers.

III.B. β-Klotho Monomer Binding Proteins

In some aspects, monomer domains are provided that bind to (e.g., selectively binds) a β-Klotho polypeptide or a portion thereof. A portion of a polypeptide can be, e.g., at least 5, 10, 15, 20, 30, 50, 100, or more contiguous amino acids of the polypeptide. In some embodiments, the monomers will bind to β-Klotho with a affinity stronger than $10^{-3}$ M (e.g., $10^{-4}$ M, etc.). In some embodiments, the affinity is stronger than $10^{-4}$ M, $10^{-5}$ M, $10^{-6}$ M, $10^{-7}$ M, $10^{-8}$ or $10^{-9}$ M.

A large number of β-Klotho binding sequences having an A domain scaffold were generated. As described in detail in the examples, five families (i.e., Families 6-9, or "Fam 6-9") of monomer domains that bind to β-Klotho were identified. The consensus motifs generated based on these families indicate common amino acid residues between the binders within the family. In addition a number of β-Klotho binding sequences having an LNR/Notch scaffold were generated. As described in detail in the Examples, one family (Family 5 or "Fam 5") of LNR/Notch monomer domains that bind to β-Klotho has been identified. The consensus motifs generated based on this family indicate common amino acid residues between the binders within the family.

III.B.1. Family 4 Sequences

Family 4 has the following consensus motif (SEQ ID NO: 130):

```
C[LAPRVKQGHS][APSHR][-T][DNGSHAF][EHQ]F[HPQTRW]C

[GSQRNLHK][SND][GSTNY][RHQGHNSE][RIT-]C[ILV]

[HNPS][AGHLSQPREV][TPGSRAHN-][WL][ILRV]CD[GMW]

[GYDVEL][PWLDN]DC[GERQLK]D[GNDSKWHY][PQSW]D[EPQY]

[APS-][LPQS-][AEHKLTV][HILSTDNGMVW]C;
```

Exemplary sequences comprising the β-Klotho Family 4 motif include the following sequences:

```
                                      (SEQ ID NO: 131)
CLPDEFQCG SGRCIPQTW VCDGLNDCGD GSDESPAHC;

(SEQ ID NO: 132)
CAANEFTCR SGRCLSRPW LCDGENDCGD GSDEADC;

(SEQ ID NO: 133)
CGSNQFTCR STNICISQAW VCDGVDDCED DSDETGC;

(SEQ ID NO: 134)
CPSNQFPCR STGICIPLAW VCDGLNDCGD GSDESPATC;

(SEQ ID NO: 135)
CPSNQFPCR STGICIPLAW VCDGLNDCGD GSDESPATC;

(SEQ ID NO: 136)
CAANEFRCS NGRCIPEPW LCDGLNDCGD GSDEPPHC;

(SEQ ID NO: 137)
CPSNEFQCQ NSGRCIPRRW LCDGEDDCGD NSDEASC;

(SEQ ID NO: 138)
CQSSEFQCS NGSCIPRPL VCDGENDCGD SSDETDC;

(SEQ ID NO: 139)
CRPGEFRCR STNTCISQSL RCDGEPDCRD GSDEPEDC;

(SEQ ID NO: 140)
CRSSEFPCH GYSTCISLSL LCDGVDDCAD NSDEESC;

(SEQ ID NO: 141)
CHHHHFHCL SGECINTW RCDGGPDCKD KSDEENC;

(SEQ ID NO: 142)
CSRAHFHCL SGECIHHHW RCDGGPDCKD KSDEENC;

(SEQ ID NO: 143)
CSAFEFHCL SGECIHSSW RCDMDWDCKD QPDQLWC;

(SEQ ID NO: 144)
CSAFEFHCL SGECIHSSW RCDWYWDCKD YWDPLVC;

(SEQ ID NO: 145)
CSAFEFHCL SGECIHSSW RCDWDDDCKD WQDYVMC;

(SEQ ID NO: 146)
CSAFEFHCL SGECIHSSW RCDWDLDCKD HPDEVMC;

(SEQ ID NO: 147)
CVPNQFPRG NGSCIPLPL VCDGVDDCLD DSDEKNC;

(SEQ ID NO: 148)
CVPNQFQCG SGRCLPHPL GCDGVDDCLD GSDEASC;

(SEQ ID NO: 149)
CVSDEFPCR DNNICVLLHL LCDGVDDCLD SSDETGC;

(SEQ ID NO: 150)
CAPSQFQCH DNNICLLEGL LCDGEDDCAD GSDEAPVC;

(SEQ ID NO: 151)
CRSSQFPCQ DSNICVLETL LCDGVDDCVD DSDEEDC;

(SEQ ID NO: 152)
CRSNQFRCN SGHCLPRPW LCDGVDDCQD DSDETDC;

(SEQ ID NO: 153)
CRPGQFWCN SGRCLPPAW RCDGVNDCGD DSDEPLALC;

(SEQ ID NO: 154)
CLPNQFRCG NGHCLSRTW VCDGVPDCED NSDESLAHC;

(SEQ ID NO: 155)
CPAGQFQCG NGQCLSLTW LCDGVPDCGD NSDESSALC;

(SEQ ID NO: 156)
CPPSQFTCG NGRCVSLGW VCDGLNDCGD GSDESPALC;

(SEQ ID NO: 157)
CPPSQFTCG NGRCVSLGW VCDGLNDCGD GSDESPALC;

(SEQ ID NO: 158)
CRPNEFPCN NGRCLSQTW VCDGLNDCGD GSDESPELC;

(SEQ ID NO: 159)
CQSNEFRCR SGRCIPQHW LCDGLNDCGD GSDESQQC;
```

```
                                         (SEQ ID NO: 160)
CQPDEFTCS SGRCIPQPW LCDGLNDCGD GSDEPPAHC;

(SEQ ID NO: 161)
CQPDEFTCR SGRCIPQPW LCDGLNDCGD GSDEPPGHC;

(SEQ ID NO: 162)
CPPNQFRCG NGHCLSVSW LCDGVPDCGD NSDEALAIC;

(SEQ ID NO: 163)
CRANEFRCN SGRCLSQTW VCDGVDDCED GSDESLAIC;

(SEQ ID NO: 164)
CRANQFTCN NGHCLSRTW LCDGVPDCED NSDESLAIC;

(SEQ ID NO: 165)
CRANQFTCN NGHCLSRTW LCDGVPDCED NSDESLAIC;

(SEQ ID NO: 166)
CRANQFTCN NGHCLSRTW LCDGVPDCED NSDESLAIC;

(SEQ ID NO: 167)
CLPGQFRCN SGHCLSQTW VCDGYNDCGD GSDEPLATC;

(SEQ ID NO: 168)
CKPTNEFRCS NGHCISRAL LCDGENDCED NSDETSC;

(SEQ ID NO: 169)
CASSEFQCR STRTCVPLGW VCDGDNDCPD NSDETDC;

(SEQ ID NO: 170)
CHSFNQFECR NGQCIPLHL VCDGVPDCGD NSDETDC;

(SEQ ID NO: 171)
CQATAQFQCD NGHCLSANW RCDGVDDCGD NSDEEDC;

(SEQ ID NO: 172)
CQATAQFQCD NGHCLSANW RCDGVDDCGD NSDEEDC;

(SEQ ID NO: 173)
CKSIAQFECS NGHCLSRTW LCDGVDDCGD NSDEALATC;

(SEQ ID NO: 174)
CRPSEFQCG NGSCLSATW LCDGVPDCGD GSDESPETC;

(SEQ ID NO: 175)
CRPNEFQCG NGHCLSANW LCDGVDDCGD DSDETSC;

(SEQ ID NO: 176)
CPSSQFQCK NGHCLSRTW LCDGVDDCQD GSDESPAIC;

(SEQ ID NO: 177)
CPSSQFQCK NGHCLSRTW LCDGVDDCQD GSDESPATC;

(SEQ ID NO: 178)
CRSSQFQCN NGHCLSPTW VCDGYDDCED GSDEANC;

(SEQ ID NO: 179)
CRSSEFQCN NGHCLSATW VCDGYDDCED GSDEANC;

(SEQ ID NO: 180)
CPANQFRCN NGHCLSRTW VCDGYDDCED GSDEANC;

(SEQ ID NO: 181)
CPANQFRCN NGHCLSGTW LCDGVDDCGD NSDESSATC;

(SEQ ID NO: 182)
CRSSEFQCG NGHCLSRTW LCDGVNDCGD DSDEKNC;

(SEQ ID NO: 183)
CLSNQFQCD NGHCLSLTW RCDGYNDCGD SSDEENC;
and (SEQ ID NO: 184)
CRSSEFKCK NGHCLSATW VCDGYVDCGD DSDEEDC.
```

III.B.2. Family 5 Sequences

Family 5 was generated by panning the naïve LNR/Notch scaffold library on recombinant β-Klotho.

Family 5 has the following consensus motif (SEQ ID NO: 1242):

```
                                                  (SEQ ID NO: 1242)
C[HNP-][AP-][HIKLMPRV-][AEILY][ADEGQRY][ADEHIKLNP
QS][DHLMSY]C[AEKPQT][AEHKNQRS][FLRY][DFVY]GDG[DEG
IKNRSV]C[DEGHNQRS][EKPQS][ADEGHPQ]C[DGNS][FLNST]
[AEPSY][AEGKRT]C[ADGILNSV]WDG[DFGLMV][DN]C
```

Exemplary sequences comprising the β-Klotho Family 5 motif include the following sequences:

```
                                                  (SEQ ID NO: 1243)
CIAAKLCEALDGDGVCHKECDLEECDWDGGDCQRIFLTDPT;

(SEQ ID NO: 1244)
CPPHIEDHCERRDGDGVCQKPCDFYGCLWDGVNCDMDLVQELT;

(SEQ ID NO: 1245)
CNPIIQHYCETYDGDGLCESACNFYGCAWDGFDCQVISDKDST;

(SEQ ID NO: 1246)
CMAYNLCTALVGDGECDQECDTPTCNWDGGDCAVKSAPDST;

(SEQ ID NO: 1247)
CMEAKSCQARDGDGDCGQGCNLAECIWDGMDCRPEWIRELT;

(SEQ ID NO: 1248)
CNPLYDDHCAAFFGDGGCGPECSLAECLWDGGDCEEERDADVT;

(SEQ ID NO: 1249)
CNDVKCKRLDGDGHASNLVTNAECLWDGLDCPDVVISDLT;

(SEQ ID NO: 1250)
CIAAKLCERLDGDGSCQSECGNATCGWDGMDCDEKENDELT;

(SEQ ID NO: 1251)
CMAYLLCKKYYGDGICRSECDTATCSWDGFDCPVNEIEDLT;

(SEQ ID NO: 1252)
CPPHIEDHCERRDGDGVCQKPCDFYGCLWDGVDCDMDLVEELT;

(SEQ ID NO: 1253)
CMAYNLCQALVGDGSCNSECDTETCGWDGMDCATVEGAEAT;

(SEQ ID NO: 1254)
CREYSMCTRFDGDGICHEQCGYPRCLWDGLDCANNFDHEVT;

(SEQ ID NO: 1255)
CNPLYDPHCRSYFGDGDCGPGCDLAACLWDGGDCPGVAAAELT;

(SEQ ID NO: 1256)
CHPLIREYCEKFFGDGGCDSGCNNSRCDWDGDDCGLIQHGDVT;

(SEQ ID NO: 1257)
CNPLYDDHCAAFFGDGGCGPECSLAECLWDGGDCEEERDADVT;

(SEQ ID NO: 1258)
CNPKYDAHCASYFGDGECDPACSLAECVWDGDDCDPNFLTDVT;

(SEQ ID NO: 1259)
CPPHIEDHCERRDGDGVCQKPCDFYGCLWDGVDCDMDLVEELT;

(SEQ ID NO: 1260)
CNPPIGQYCTQLFGDGDCGPDCDLAECVWDGDDCDPVAVPDVT;

(SEQ ID NO: 1261)
CNPVYDPYCAAFFGDGGCGPHCGLAECVWDGMDCDHKEVRELT;

(SEQ ID NO: 1262)
CHPLIREYCTHYDGDGECDKGCDSAKCKWDGDDCDMDVLAEVT;

(SEQ ID NO: 1263)
CHPLIREYCTHYDGDGECDKGCDSAKCKWDGDDCDMDVLAEVT;
```

III.B.3. Family 6 Sequences

Family 6 was generated by mutating β-Klotho M01 (SEQ ID NO: 493) and selecting for monomer domains with increased binding affinity for β-Klotho.

Family 6 has the following consensus motif (SEQ ID NO: 185):

C[LMP][PST][DH]EF[QR]C[GR]SG[RW]CIP[LQR][AKRST]W[GV]CDGLNDCGDGSGE[SW]PA[HLQ]C;

Exemplary sequences comprising the β-Klotho Family 6 motif include the following sequences:

```
                                        (SEQ ID NO: 186)
CLPDEFQCGSGRCIPLTWVCDGLNDCGDGSDESPAHC;

(SEQ ID NO: 187)
CLPDEFQCRSGRCIPQTWVCDGLNDCGDGSDESPAQC;

(SEQ ID NO: 188)
CLPHEFQCGSGRCIPQTWVCDGLNDCGDGSDEWPAQC;

(SEQ ID NO: 189)
CLPHEFQCRSGRCIPQAWGCDGLNDCGDGSDESPAQC;

(SEQ ID NO: 190)
CLSDEFQCRSGRCIPQRWVCDGLNDCGDGSDEWPAQC;

(SEQ ID NO: 191)
CMPDEFQCRSGRCIPRSWVCDGLNDCGDGSDESPSHC;

(SEQ ID NO: 192)
CMTDEFRCRSGRCIPQTWVCDGLNDCGDGSDEWPAQC;
and (SEQ ID NO: 193)
CPPDEFQCRSGWCIPQKWVCDGLNDCGDGSDESPALC.
```

III.B.4. Family 7 Sequences

Family 7 was generated by mutating β-Klotho M25 (SEQ ID NO: 519) and selecting for monomer domains with increased binding affinity for β-Klotho.

Family 7 has the following consensus motif (SEQ ID NO:194):

C[LRW][PST][GS][AEHQS]F[HQ]C[NS][NT]GHCLS[APQRS][ST]WVCDG[FY][DEVY]DC[DEG]D[GW]SDE[ASV][KN]C;

Exemplary sequences comprising the β-Klotho Family 7 motif include the following sequences:

```
                                        (SEQ ID NO: 195)
CLPSQFQCNNGHCLSRTWVCDGYDDCGDWSDESNC;

(SEQ ID NO: 196)
CLSGQFQCSNGHCLSRTWVCDGYVDCEDGSDEAKC;

(SEQ ID NO: 197)
CLSSSFQCNNGHCLSRTWVCDGYYDCEDGSDEVNC;

(SEQ ID NO: 198)
CRSGQFQCNNGHCLSATWVCDGYDDCDDGSDEANC;

(SEQ ID NO: 199)
CRSGQFQCNNGHCLSQTWVCDGYDDCDDGSDEANC;

(SEQ ID NO: 200)
CRSGQFQCNNGHCLSRTWVCDGYDDCDDGSDEANC;

(SEQ ID NO: 201)
CRSGQFQCNNGHCLSSTWVCDGFDDCEDGSDEANC;

(SEQ ID NO: 202)
CRSSEFQCNNGHCLSATWVCDGYDDCEDGSDESNC;

(SEQ ID NO: 203)
CRSSEFQCNTGHCLSRTWVCDGYDDCGDGSDEANC;

(SEQ ID NO: 204)
CRTSHFHCNNGHRLSRTWVCDGYEDCEDGSDEANC;

(SEQ ID NO: 205)
CWSSAFQCNNGHCLSPSWVCDGYDDCGDGSDEANC;
and (SEQ ID NO: 206)
CRSGQFQCNNGHCLSATWVCDGYDDCDDGSDEANC.
```

III.B.5. Family 8 Sequences

Family 8 was generated by mutating β-Klotho M42 (SEQ ID NO: 305) and selecting for monomer domains with increased binding affinity for β-Klotho.

Family 8 has the following consensus motif (SEQ ID NO: 207):

C[EQ][PS][DE]EF[MRT]C[RS]SGRCIP[QV][HIST]WLCDGLNDCGDGSDE[PR]P[AE][HQ]C;

Exemplary sequences comprising the β-Klotho Family 8 motif include the following sequences:

```
                                        (SEQ ID NO: 208)
CEPEEFRCRSGRCIPQTWLCDGLNDCGDGSDEPPAHC;

(SEQ ID NO: 209)
CQPDEFTCRSGRCIPQSWLCDGLNDCGDGSDEPPAHC;

(SEQ ID NO: 210)
CQPDEFTCSSGRCIPQIWLCDGLNDCGDGSDERPEHC;
and (SEQ ID NO: 211)
CQSDEFMCSSGRCIPVHWLCDGLNDCGDGSDERPAQC.
```

III.B.5. Family 9 Sequences

Family 9 was generated by mutating β-Klotho M50 (SEQ ID NO: 306) and selecting for monomer domains with increased binding affinity for β-Klotho.

Family 9 has the following consensus motif (SEQ ID NO: 212):

C[HNP][STW]F[HN][HKQ]F[EK]CRN[GR]QCIPL[HY]LVCDGVPDC[AG]D[DN]SDET[ADY]C;

Exemplary sequences comprising the β-Klotho Family 9 motif include the following sequences:

```
                                        (SEQ ID NO: 213)
CHSFNQFECRNRQCIPLYLVCDGVPDCADNSDETDC;

(SEQ ID NO: 214)
CHTFNKFECRNGQCIPLYLVCDGVPDCGDNSDETAC;

(SEQ ID NO: 215)
CNSFNQFECRNRQCIPLYLVCDGVPDCGDNSDETYC;
and (SEQ ID NO: 216)
CPWFHHFKCRNGQRIPLHLVCDGVPDCGDDSDETDC.
```

III.C. β-Klotho Dimer Binding Proteins

As described herein, monomer domains can be linked to form multimers that bind the same target (e.g., β-Klotho). The present disclosure provides polypeptides comprising both homo—(i.e., at least two identical monomers) and hetero—(i.e., different monomers that bind the same target) multimers. Additional libraries, referred to as "walking libraries," were generated by ligating phage display-selected monomers (i.e. selected monomers) with the full representation of a naïve monomer library.

In some aspects, dimer domains are provided that bind to (e.g., selectively binds) a β-Klotho polypeptide or a portion thereof. A portion of a polypeptide can be, e.g., at least 5, 10, 15, 20, 30, 50, 100, or more contiguous amino acids of the polypeptide. In some embodiments, the dimers will bind to β-Klotho with a affinity stronger than $10^{-3}$ M (e.g., $10^{-4}$ M, etc.). In some embodiments, the affinity is stronger than $10^{-4}$ M, $10^{-5}$ M, $10^{-6}$ M, $10^{-7}$ M, $10^{-8}$, $10^{-9}$ M or $10^{-10}$ M.

A large number of β-Klotho binding sequences comprising two monomer domains were generated. As described in detail in the examples, twelve families (i.e., Families 10-21, or "Fam 10-21") of monomer domains that bind to β-Klotho have been identified. These are summarized in FIG. 14. The consensus motifs generated based on these families indicate common amino acid residues between the binders within the family.

III.C.1. Family 10 Sequences

Family 10 was generated by ligating the full representation of a naïve monomer library to the C-terminal of β-Klotho M01 (SEQ ID NO: 493) and selecting for dimer domains with increased binding affinity for β-Klotho.

Family 10 has the following consensus motif for the second domain (SEQ ID NO: 217):

C[ELPQR][APS][DGIN][EGQ][FQ][FKPQRT][-E]C[GNRS]

[NS]G[HNQR]C[IV]P[AELPQRV][AHPQRT]W[LRV]CDG[DEV]

[DNP]DC[GLQ]D[DGNS]SDE[AEKT][DGLNS][-A][-H]C

Exemplary sequences comprising the β-Klotho Family 10 (second domain) motif include the following sequences:

```
betaKlothoWD01
                                    (SEQ ID NO: 218)
CRAGEFRCSNGRCVPLTWLCDGEDDCQDNSDEKNC;

betaKlothoWD02
                                    (SEQ ID NO: 219)
CPSSEFRCNNGRCIPLHWVCDGDDDCQDNSDETDC;

betaKlothoWD03
                                    (SEQ ID NO: 220)
CRPGEFRCNNGRCVPQTWVCDGEDDCGDNSDETDC;

betaKlothoWD04
                                    (SEQ ID NO: 221)
CLSDQFRCGNGRCVPRAWLCDGDNDCQDGSDETNC;

betaKlothoWD05
                                    (SEQ ID NO: 222)
CLPGQFPCGNGRCIPETWLCDGDDDCQDGSDEKGC;

betaKlothoWD06
                                    (SEQ ID NO: 223)
CQPNEFQCGNGRCIPAQWLCDGEDDCQDNSDEEDC;

betaKlothoWD07
                                    (SEQ ID NO: 224)
CESIGQFECGNGHCIPPTWLCDGVNDCQDSSDEALAHC;

betaKlothoWD08
                                    (SEQ ID NO: 225)
CQSNEFRCRNGQCIPLTWLCDGDNDCLDSSDEESC;

betaKlothoWD09
                                    (SEQ ID NO: 226)
CPSGEFTCGSGRCIPPTWVCDGEPDCLDGSDEKSC;

betaKlothoWD10
                                    (SEQ ID NO: 227)
CLPDEFKCGSGRCIPLRWVCDGDDDCQDGSDETDC;

betaKlothoWD15
                                    (SEQ ID NO: 228)
CPSNQFPCRSTGICIPLAWVCDGLNDCGDGSDESPATC;

BK_R1c_D14
                                    (SEQ ID NO: 229)
CRSDEFRCGNGRCIPLTWVCDGEDDCQDSSDETGC;

BK_R1c_D15
                                    (SEQ ID NO: 230)
CRSNQFTCGNGNCIPQPWVCDGEDDCGDDSDEESC;
and BK_R1c_D16
                                    (SEQ ID NO: 231)
CPPGQFRCNNGRCIPVHWRCDGENDCQDDSDEKSC.
```

III.C.2. Family 11 Sequences

Family 11 was generated by ligating the full representation of a naïve monomer library to the N-terminal of β-Klotho M01 (SEQ ID NO: 493) and selecting for dimer domains with increased binding affinity for β-Klotho.

Family 11 has the following consensus motif for the second domain (SEQ ID NO: 232):

C[AGLP]PD[EQ]F[KR]C[GKNRS]SG[NQRS]C[IL]P[ELQ]

[DHNT]W[LRV]CDG[DLV][DN]DC[EGV]D[GS]SDE[AET]

[DGNP][-D][-L]C

Exemplary sequences comprising the β-Klotho Family 11 (second domain) motif include the following sequences:

```
betaKlothoWD11
                                    (SEQ ID NO: 233)
CPPDQFRCRSGRCIPQHWLCDGLNDCGDGSDEANC;

betaKlothoWD12
                                    (SEQ ID NO: 234)
CAPDQFRCSSGQCIPETWLCDGDDDCVDSSDEAGC;

betaKlothoWD13
                                    (SEQ ID NO: 235)
CGPDEFRCNSGRCLPLDWRCDGVDDCEDGSDEAPDLC;

betaKlothoWD14
                                    (SEQ ID NO: 236)
CGPDQFRCKSGNCLPLNWVCDGVDDCGDSSDEEGC;

betaKlothoWD16
                                    (SEQ ID NO: 237)
CLPDEFRCGSGRCIPQTWVCDGLNDCGDGSDETGC;

BK_R1c_D06
                                    (SEQ ID NO: 238)
CAPDQFRCSSGQCIPETWLCDGDDDCVDSSDEAGC;
and BK_R1c_D12
                                    (SEQ ID NO: 239)
CGPDQFKCNSGSCIPLTWVCDGDNDCGDDSDETDC.
```

III.C.3. Family 12 Sequences

Family 12 was generated by ligating the full representation of a naïve monomer library to the N-terminal of β-Klotho M06 (SEQ ID NO: 499) and selecting for dimer domains with increased binding affinity for β-Klotho.

Family 12 has the following consensus motif for the second domain (SEQ ID NO: 240):

CA[PS][DNS][EQ]F[QR]C[GH][DN][GNT][GHN][-IT]

C[IL][LPS][ER][AGT][WL]LCDG[DEV][DN]DC[AEG]

DGSDE[AE][DG]C

Exemplary sequences comprising the β-Klotho Family 12 (second domain) motif include the following sequences:

```
betaKlotho WD18
                                    (SEQ ID NO: 241)
CASNQFRCGNGHCLSRTWLCDGVNDCEDGSDEADC;
betaKlotho WD19
                                    (SEQ ID NO: 242)
CAPDEFRCHNTGTCIPRAWLCDGDNDCGDGSDEEGC;
betaKlotho WD20
                                    (SEQ ID NO: 243)
CAPSQFQCHDNNICLLEGLLCDGEDDCADGSDEADC;
and BK_R1c_D09
                                    (SEQ ID NO: 244)
CASNQFRCGNGHCLSRTWLCDGVNDCEDGSDEADC.
```

III.C.4. Family 13 Sequences

Family 13 was generated by ligating the full representation of a naïve monomer library to the C-terminal of β-Klotho M06 (SEQ ID NO: 499) and selecting for dimer domains with increased binding affinity for β-Klotho.

Family 13 has the following consensus motif for the second domain (SEQ ID NO: 245):

C[AP]P[DG][EQ]F[RT]C[KNR][NS]G[QR]C[IV]P[LQ][AHP]

W[LV]CDG[DE][DN]DC[GQ]DNSDE[EST][DNP][-A][-T]C

Exemplary sequences comprising the β-Klotho Family 13 (second domain) motif include the following sequences:

```
betaKlothoWD17
                                    (SEQ ID NO: 246)
CPPDQFRCRNGRCVPLAWVCDGEDDCQDNSDETDC;
BK_R1c_D19
                                    (SEQ ID NO: 247)
CAPGEFTCKSGQCIPLHWLCDGDNDCGDNSDESPATC;
and BK_R1c_D20
                                    (SEQ ID NO: 248)
CPPGQFRCNNGRCIPQPWLCDGDDDCQDNSDEENC.
```

III.C.5. Family 14 Sequences

Family 14 was generated by ligating the full representation of a naïve monomer library to the N-terminal of β-Klotho M08 (SEQ ID NO: 694) and selecting for dimer domains with increased binding affinity for β-Klotho.

Family 14 has the following consensus motif for the second domain (SEQ ID NO: 249):

C[AGPR][AP][DGNS][EQ]F[QRT]C[GSK]N[GT][GHR][-R]

C[ILV][PS][ALQ][NST]W[LRV]CDG[DEV]DDC[GL]DGSDE

[AET][DNS][-A][-T]C

Exemplary sequences comprising the β-Klotho Family 14 (second domain) motif include the following sequences:

```
betaKlotho WD21
                                    (SEQ ID NO: 250)
CAPGEFTCKNTGRCIPLNWRCDGDDDCGDGSDETDC;
betaKlotho WD22
                                    (SEQ ID NO: 251)
CPADEFRCSNTGRCVPLSWLCDGEDDCGDGSDETNC;
betaKlotho WD23
                                    (SEQ ID NO: 252)
CGPSQFQCSNGRCLPATWVCDGDDDCLDGSDEASATC;
and BK_R1c_D25
                                    (SEQ ID NO: 253)
CRPNEFRCGNGHCLSQTWVCDGVDDCLDGSDEESC.
```

III.C.6. Family 15 Sequences

Family 15 was generated by ligating the full representation of a naïve monomer library to the N-terminal of β-Klotho M21 (SEQ ID NO: 508) and selecting for dimer domains with increased binding affinity for β-Klotho.

Family 15 has the following consensus motif for the second domain (SEQ ID NO: 254):

C[AGP][APS][DGN][EQ]F[QRT]C[GNRS][GNS][GT][GKQS]

[-IK]C[ILV]P[LQRV][AEHP]W[LRV]CDG[DLV][DN]DCGD

[GN]SDE[AEKPS][GLPS][-AEV][-IT]C

Exemplary sequences comprising the β-Klotho Family 15 (second domain) motif include the following sequences:

```
betaKlotho WD27
                                    (SEQ ID NO: 255)
CGPDQFRCSSGKCIPQHWLCDGLNDCGDGSDESPATC;
betaKlotho WD28
                                    (SEQ ID NO: 256)
CGANEFQCRSTGICVPVEWVCDGDNDCGDGSDEPPVC;
betaKlotho WD29
                                    (SEQ ID NO: 257)
CGADQFRCGNGSCVPRAWRCDGVDDCGDGSDEAPEIC;
betaKlotho WD25
                                    (SEQ ID NO: 258)
CGPDEFRCNNGQCIPLPWRCDGVDDCGDNSDEPLEIC;
BK_R1c_D08
                                    (SEQ ID NO: 259)
CASGEFTCNNGQCVPLAWRCDGVNDCQDGSDEKGC;
BK_R1c_D11
                                    (SEQ ID NO: 260)
CGPDEFRCNNGQCIPLPWRCDGVDDCGDNSDEPLEIC;
and BK_R1c_D18
                                    (SEQ ID NO: 261)
CPPDEFQCRGTKKCLPLAWVCDGDNDCEDDSDEESC.
```

III.C.7. Family 16 Sequences

Family 16 was generated by ligating the full representation of a naïve monomer library to the C-terminal of β-Klotho M21 (SEQ ID NO: 508) and selecting for dimer domains with increased binding affinity for β-Klotho.

Family 16 has the following consensus motif for the second domain (SEQ ID NO: 262):

C[AP][AP][GN]QF[RT]C[GR]NG[NS]CIP[AL][HT]W[LV]

CDGDNDC[GQ]D[GN]SDE[ET][DN]C

Exemplary sequences comprising the β-Klotho Family 17 (second domain) motif include the following sequences:

```
betaKlotho WD24
                                 (SEQ ID NO: 263)
CPPGQFRCRNGSCIPATWLCDGDNDCGDNSDEEDC;
and betaKlotho WD26
                                 (SEQ ID NO: 264)
CAANQFTCGNGNCIPLHWVCDGDNDCQDGSDETNC.
```

III.C.8. Family 17 Sequences

Family 17 was generated by ligating the full representation of a naïve monomer library to the N-terminal of β-Klotho M42 (SEQ ID NO: 305) and selecting for dimer domains with increased binding affinity for β-Klotho.

Family 17 has the following consensus motif for the second domain (SEQ ID NO: 265):

C[APQR][ASP][DG][EQ]F[PQ]C[EKNR][NS][GT][GHN]

[-R]C[ILV][PS][ALPR][ANRT]W[LRV]CDG[EV][DN]DC

[AGR]D[GNS]SDE[AEKS][GLNS][-A][-H]C

Exemplary sequences comprising the β-Klotho Family 17 (second domain) motif include the following sequences:

```
betaKlotho WD31
                                 (SEQ ID NO: 266)
CAPDQFRCKSGNCIPLAWRCDGEDDCRDGSDEESC;

betaKlotho WD32
                                 (SEQ ID NO: 267)
CQAGQFQCESGNCVPPNWLCDGENDCADSSDEANC;

BK_R1c_D21
                                 (SEQ ID NO: 268)
CPSGQFQCNNGHCLSATWLCDGVDDCGDGSDEKGC;
and BK_R1c_D24
                                 (SEQ ID NO: 269)
CRPDEFPCRSTGRCVPRRWVCDGVDDCGDNSDESLAHC.
```

III.C.9. Family 18 Sequences

Family 18 was generated by ligating the full representation of a naïve monomer library to the C-terminal of β-Klotho M42 (SEQ ID NO: 305) and selecting for dimer domains with increased binding affinity for β-Klotho.

Family 18 has the following consensus motif for the second domain (SEQ ID NO: 270):

CRP[DG]EF[QR]C[GKR][NS]G[HR]C[IV]P[GLQ][PT]W[RV]

CDG[DE][DP]DCQD[GS]SDE[AET][DGN]C

Exemplary sequences comprising the β-Klotho Family 18 (second domain) motif include the following sequences:

```
betaKlotho WD30
                                 (SEQ ID NO: 271)
CRPGEFQCGSGHCIPGPWVCDGDPDCQDGSDEANC;

BK_R1c_D22
                                 (SEQ ID NO: 272)
CRPDEFRCKNGRCIPQTWVCDGEDDCQDSSDETDC;
and BK_R1c_D23
                                 (SEQ ID NO: 273)
CRPDEFRCRNGRCVPLTWRCDGEDDCQDGSDEEGC.
```

III.C.10. Family 19 Sequences

Family 19 was generated by ligating the full representation of a naïve monomer library to the N-terminal of β-Klotho M50 (SEQ ID NO: 306) and selecting for dimer domains with increased binding affinity for β-Klotho.

Family 19 has the following consensus motif for the second domain (SEQ ID NO: 274):

C[AGLR][APS][DGN][EQ]F[RQT]C[GHKNRS][NS][GSTY]

[DEGNR][-RT]C[ILV]P[AGLPRV][AHNPT]W[LRV]CDG[DEV]

[DN]DC[AEGRV]D[DGN]SDE[AEST][ADGNS][-D]C

Exemplary sequences comprising the β-Klotho Family 19 (second domain) motif include the following sequences:

```
betaKlotho WD35
                                 (SEQ ID NO: 275)
CAPGEFQCSNGNCLPPNWLCDGVDDCGDGSDESADC;

betaKlotho WD36
                                 (SEQ ID NO: 276)
CAPDEFRCRNGNCIPLPWVCDGENDCRDDSDEEDC;

betaKlotho WD37
                                 (SEQ ID NO: 277)
CLSDQFQCNNYETCIPRPWLCDGDDDCVDGSDEEDC;

betaKlotho WD38
                                 (SEQ ID NO: 278)
CAAGEFQCSSGRCLPRPWVCDGDNDCGDDSDETNC;

betaKlotho WD39
                                 (SEQ ID NO: 279)
CRSGEFRCKNGRCIPQHWVCDGENDCGDDSDETNC;

BK_R1c_D05
                                 (SEQ ID NO: 280)
CAAGQFRCHNSDTCLPGAWVCDGDNDCGDNSDEASC;

BK_R1c_D07
                                 (SEQ ID NO: 281)
CAPNEFRCRSTGRCIPVNWVCDGDDDCADNSDEAGC;

BK_R1c_D10
                                 (SEQ ID NO: 282)
CGADQFQCGSGRCVPATWRCDGEDDCGDGSDEENC
and BK_R1c_D17
                                 (SEQ ID NO: 283)
CLPGQFTCGNGRCIPLPWVCDGVNDCEDNSDEESC.
```

III.C.11. Family 20 Sequences

Family 20 was generated by ligating the full representation of a naïve monomer library to the C-terminal of β-Klotho M50 (SEQ ID NO: 306) and selecting for dimer domains with increased binding affinity for β-Klotho.

Family 20 has the following consensus motif for the second domain (SEQ ID NO: 284):

C[LQ][PS]G[EQ]FRC[KQ][NT][GT]R[-T]C[IL]P[LR][AK]

[LW][LV]CDGVDDC[EL]DDSDE[AK]DC

Exemplary sequences comprising the β-Klotho Family 20 (second domain) motif include the following sequences:

betaKlotho WD33

(SEQ ID NO: 285)
CQSGEFRCQNTRTCLPLKLLCDGVDDCLDDSDEKDC;
and betaKlotho WD34

(SEQ ID NO: 286)
CLPGQFRCKTGRCIPRAWVCDGVDDCEDDSDEADC.

III.D. FGFR1c and β-Klotho Bispecific Binding Proteins

A number of binding proteins were made that specifically bind both FGFR1c and β-Klotho. These bispecific binding proteins were formed by joining a FGFR1c-binding sequence selected from one of Families 1-3 to a β-Klotho-binding sequence selected from one of Families 4-20 in various combinations via a linker. The sequences from Families 1-3 that were used in preparing the bispecific proteins were:

(SEQ ID NO: 287)
CGAGLFTCRSTKICISQAWVCDGVDDCEDNSDEKNCSAPASEPPGSL (SEQ ID NO: 288)
CGAGQFTCRDTNICISRAWRCDGVDDCEDNSDEADCSQDPEFHKV (SEQ ID NO: 289)
CGANQFTCHNTNICISQAWVCDGVDDCEDNSDEKNCSAPASEPPGSL (SEQ ID NO: 290)
CGSNQFTCRSTNICISQAWVCDGVDDCEDDSDETGCSQDPEFHKV (SEQ ID NO: 291)
CLSDQFTCRSTNICLPLQWVCDGDDDCEDNSDEEDCSAPASEPPGSL (SEQ ID NO: 292)
CRLNEFPCGSGSCISLHWVCDSVPDCRDDSDETDCPERT (SEQ ID NO: 293)
CGAGLFTCRSTNICISQVWVCDGVDDCEDNSDEDSCSAPASEPPGSL (SEQ ID NO: 294)
CGAGLFTCRSTNICISQAWVCDGVDDCEDNSDENYCSAPASEPPGSL (SEQ ID NO: 295)
CGAGLFTCRSTNICISQAWVCDGVDDCEDNSDETNCSAPASEPPGSL (SEQ ID NO: 296)
CGASLFTCRRSNICISQAWVCDGVDDCEDNSDEMNCSAPASEPPGSL (SEQ ID NO: 297)
CGEGLFTCRSTNICISHAWVCDGVDDCEDNSDENNCSAPASEPPGSL (SEQ ID NO: 298)
CGANLFTCQSTNICISDAWVCDGVDDCEDNSDETTCSQDPEFHKV (SEQ ID NO: 299)
CGANLFTCRSTNICISPAWVCDGVDDCEDYSDEIGCSQDPEFHKV (SEQ ID NO: 300)
CGSDMFTCRSTNICISKVWVCDGVDDCEDDSDERGCSQDPEFHKV (SEQ ID NO: 301)
CGSNLFTCRRTNICISKAWVCDGVDDCEDNSDETGCSQDPEFHKV (SEQ ID NO: 302)
CGSNLFTCRSTNICISPAWVCDGVDDCDDDSDETGCSQDPEFHKV (SEQ ID NO: 303)
CGTNLFTCRSTNMCISQAWVCDGVDDCEDNSDETVCSQDPEFHKV

The sequences from Families 4-20 that were used in preparing the bispecific proteins were:

M01

(SEQ ID NO: 304)
CLPDEFQCGSGRCIPQTWVCDGLNDCGDGSDESPAHCSQDPEFHKV

M42

(SEQ ID NO: 305)
CQPDEFTCSSGRCIPQPWLCDGLNDCGDGSDEPPAHCSAPASEPPGSL

M50

(SEQ ID NO: 306)
CHSFNQFECRNGQCIPLHLVCDGVPDCGDNSDETDCGDSHILPFSTPG
PST

LNR_M01

(SEQ ID NO: 1243)
CIAAKLCEALDGDGVCHKECDLEECDWDGGDCQRIFLTDPT

WD01

(SEQ ID NO: 307)
CLPDEFQCGSGRCIPQHWLCDGLNDCGDGSDEPPAHCSAPASEPPGSL
CRAGEFRCSNGRCVPLTWLCDGEDDCQDNSDEKNCAQPT

WD02

(SEQ ID NO: 308)
CLPDEFQCSSGRCIPQTWVCDGLNDCGDGSDESPAHCSQDPEFHKVCP
SSEFRCNNGRCIPLHWVCDGDDDCQDNSDETDCERSGRT

WD03

(SEQ ID NO: 309)
CLPDEFQCGSGRCIPQTWVCDGLNDCGDGSDESPAHCSQDPEFHKVCR
PGEFRCNNGRCVPQTWVCDGEDDCGDNSDETDCSAPASEPPGSL

WD04

(SEQ ID NO: 601)
CLPDEFQCGSGRCIPQTWVCDGLNDCGDGSDESPAHCSQDPEFHKVCL
SDQFRCGNGRCVPRAWLCDGDNDCQDGSDETNCEQPT

WD05

(SEQ ID NO: 1264)
CLPDEFQCGSGRCIPQTWVCDGLNDCGDGSDESPAHCSQDPEFHKVCL
PGQFPCGNGRCIPETWLCDGDDDCQDGSDEKGCAQPT

WD06

(SEQ ID NO: 310)
CLPDEFQCGSGRCIPQTWVCDGLNDCGDGSDESPAHCSQDPEFHKVCQ
PNEFQCGNGRCIPAQWLCDGEDDCQDNSDEEDCTEHT

WD08

(SEQ ID NO: 603)
CLPDEFQCGSGRCIPQTWVCDGLNDCGDGSDESPAHCSQDPEFHKVCQ
SNEFRCRNGQCIPLTWLCDGDNDCLDSSDEESCPAHT

WD21

(SEQ ID NO: 633)
CAPGEFTCKNTGRCIPLNWRCDGDDDCGDGSDETDCPAPTCPSNQFPC
RSTGICIPLAWVCDGLNDCGDGSDESPAHCSAPASEPPGSL

WD22

(SEQ ID NO: 311)
CPADEFRCSNTGRCVPLSWLCDGEDDCGDGSDETNCKAHTCPSNQFPC
RSTGICIPLAWVCDGLNDCGDGSDESPATCKAPVPT

WD25

(SEQ ID NO: 640)
CGPDEFRCNNGQCIPLPWRCDGVDDCGDNSDEPLEICQAPTCQSNEFR
CRSGRCIPQHWLCDGLNDCGDGSDEPPAHCSAPASEPPGSL

WD28

(SEQ ID NO: 643)
CGANEFQCRSTGICVPVEWVCDGDNDCGDGSDEPPVCGDSHILPFSTP
GPSTCQPDEFTCSSGRCIPQPWLCDGLNDCGDGSDEPPAHCSAPASEP
PGSL

WD29

(SEQ ID NO: 312)
CGADQFRCGNGSCVPRAWRCDGVDDCGDGSDEAPEICETPTCQSNEFR
CRSGRCIPQHWLCDGLNDCGDGSDESQQCSAPASEPPGSL

WD31

(SEQ ID NO: 313)
CLPDEFRCGNGNCISVAWRCDGVDDCEDGSDEEDCESPEHTCQSNEFR
CRSGRCIPQHWLCDGLNDCGDGSDESPAHCSQDPEFHKV

The bispecific polypeptides that were generated include the following sequences (summarized in FIGS. 22A-22C and 32):

R1c M15-bKM01 (C2114)
(SEQ ID NO: 314)
CGANQFTCHNTNICISQAWVCDGVDDCEDNSDEKNCSAPASEPPGSLC
LPDEFQCGSGRCIPQTWVCDGLNDCGDGSDESPAHCSQDPEFHKV

R1c M15-(G4S) (SEQ ID NO: 2)-bKM01 (C2139)
(SEQ ID NO: 315)
CGANQFTCHNTNICISQAWVCDGVDDCEDNSDEKNCSAPASEPPGSLG
GGGSCLPDEFQCGSGRCIPQTWVCDGLNDCGDGSDESPAHCSQDPEFH
KV

R1c M15-(G4S)2 (SEQ ID NO: 3)-bKM01 (C2140)
(SEQ ID NO: 316)
CGANQFTCHNTNICISQAWVCDGVDDCEDNSDEKNCSAPASEPPGSLG
GGGSGGGGSCLPDEFQCGSGRCIPQTWVCDGLNDCGDGSDESPAHCSQ
DPEFHKV

R1c M15-(G4S)3 (SEQ ID NO: 4)-bKM01 (C2122)
(SEQ ID NO: 317)
CGANQFTCHNTNICISQAWVCDGVDDCEDNSDEKNCSAPASEPPGSLG
GGGSGGGGSGGGGSCLPDEFQCGSGRCIPQTWVCDGLNDCGDGSDESP
AHCSQDPEFHKV bKM01-R1c M15 (C2130)
(SEQ ID NO: 318)
CLPDEFQCGSGRCIPQTWVCDGLNDCGDGSDESPAHCSQDPEFHKVCG
ANQFTCHNTNICISQAWVCDGVDDCEDNSDEKNCSAPASEPPGSL bKM01-(G4S)2 (SEQ ID NO: 3)-R1c M15 (C2131)
(SEQ ID NO: 319)
CLPDEFQCGSGRCIPQTWVCDGLNDCGDGSDESPAHCSQDPELHKVSL
GGGGSGGGGSCGANQFTCHNTNICISQAWVCDGVDDCEDNSDEKNCSA
PASEPPGSL bKM01-(G4S)3 (SEQ ID NO: 4)-R1c M15 (C2132)
(SEQ ID NO: 320)
CLPDEFQCGSGRCIPQTWVCDGLNDCGDGSDESPAHCSQDPELHKVSL
GGGGSGGGGSGGGGSCGANQFTCHNTNICISQAWVCDGVDDCEDNSDE
KNCSAPASEPPGSL

R1c M15-bKM42 (C2116)
(SEQ ID NO: 321)
CGANQFTCHNTNICISQAWVCDGVDDCEDNSDEKNCSAPASEPPGSLC
QPDEFTCSSGRCIPQPWLCDGLNDCGDGSDEPPAHCSAPASEPPGSL

R1c M15-(G4S) (SEQ ID NO: 2)-bKM42 (C2120)
(SEQ ID NO: 322)
CGANQFTCHNTNICISQAWVCDGVDDCEDNSDEKNCSAPASEPPGSLG
GGGSCQPDEFTCSSGRCIPQPWLCDGLNDCGDGSDEPPAHCSAPASEP
PGSL

R1c M15-(G4S)2 (SEQ ID NO: 3)-bKM42 (C2141)
(SEQ ID NO: 323)
CGANQFTCHNTNICISQAWVCDGVDDCEDNSDEKNCSAPASEPPGSLG
GGGSGGGGSCQPDEFTCSSGRCIPQPWLCDGLNDCGDGSDEPPAHCSA
PASEPPGSL

R1c M15-(G4S)3 (SEQ ID NO: 4)-bKM42 (C2142)
(SEQ ID NO: 324)
CGANQFTCHNTNICISQAWVCDGVDDCEDNSDEKNCSAPASEPPGSLG
GGGSGGGGSGGGGSCQPDEFTCSSGRCIPQPWLCDGLNDCGDGSDEPP
AHCSAPASEPPGSL bKM42-R1c M15 (C2133)
(SEQ ID NO: 325)
CQPDEFTCSSGRCIPQPWLCDGLNDCGDGSDEPPAHCSAPASEPPGSL
CGANQFTCHNTNICISQAWVCDGVDDCEDNSDEKNCSAPASEPPGSL bKM42-(G4S) (SEQ ID NO: 2)-R1c M15 (C2134)
(SEQ ID NO: 326)
CQPDEFTCSSGRCIPQPWLCDGLNDCGDGSDEPPAHCSAPASEPPGSL
SLGGGGSCGANQFTCHNTNICISQAWVCDGVDDCEDNSDEKNCSAPAS
EPPGSL bKM42-(G4S)2 (SEQ ID NO: 3)-R1c M15 (C2135)
(SEQ ID NO: 327)
CQPDEFTCSSGRCIPQPWLCDGLNDCGDGSDEPPAHCSAPASEPPGSL
SLGGGGSGGGGSCGANQFTCHNTNICISQAWVCDGVDDCEDNSDEKNC
SAPASEPPGSL

-continued bKM42-(G4S)3 (SEQ ID NO: 4)-R1c M15 (C2136)
(SEQ ID NO: 328)
CQPDEFTCSSGRCIPQPWLCDGLNDCGDGSDEPPAHCSAPASEPPGSL
SLGGGGSGGGGSGGGGLFMCGANQFTCHNTNICISQAWVCDGVDDCED
NSDEKNCSAPASEPPGSL R1c M15-bKM50 (C2117)
(SEQ ID NO: 329)
CGANQFTCHNTNICISQAWVCDGVDDCEDNSDEKNCSAPASEPPGSLC
HSFNQFECRNGQCIPLHLVCDGVPDCGDNSDETDCGDSHILPFSTPGP
ST R1c M15-(G4S) (SEQ ID NO: 2)-bKM50 (C2121)
(SEQ ID NO: 330)
CGANQFTCHNTNICISQAWVCDGVDDCEDNSDEKNCSAPASEPPGSLG
GGGSCHSFNQFECRNGQCIPLHLVCDGVPDCGDNSDETDCGDSHILPF
STPGPST R1c M15-(G4S)2 (SEQ ID NO: 3)-bKM50 (C2143)
(SEQ ID NO: 331)
CGANQFTCHNTNICISQAWVCDGVDDCEDNSDEKNCSAPASEPPGSLG
GGGSGGGGSCHSFNQFECRNGQCIPLHLVCDGVPDCGDNSDETDCGDS
HILPFSTPGPST R1c M15-(G4S)3 (SEQ ID NO: 4)-bKM50 (C2144)
(SEQ ID NO: 332)
CGANQFTCHNTNICISQAWVCDGVDDCEDNSDEKNCSAPASEPPGSLG
GGGSGGGGSGGGGSCHSFNQFECRNGQCIPLHLVCDGVPDCGDNSDET
DCGDSHILPFSTPGPST bKM50-R1c M15 (C2137)
(SEQ ID NO: 333)
CHSFNQFECRNGQCIPLHLVCDGVPDCGDNSDETDCGDSHILPFSTPG
PSTCGANQFTCHNTNICISQAWVCDGVDDCEDNSDEKNCSAPASEPPG
SL bKM50-(G4S) (SEQ ID NO: 2)-R1c M15 (C2138)
(SEQ ID NO: 334)
CHSFNQFECRNGQCIPLHLVCDGVPDCGDNSDETDCGDSHILPFSTPG
PSTGGGSCGANQFTCHNTNICISQAWVCDGVDDCEDNSDEKNCSAPA
SEPPGSL bKWD01_R1cM03mut01 (C3090)
(SEQ ID NO: 335)
CLPDEFQCGSGRCIPQHWLCDGLNDCGDGSDEPPAHCSAPASEPPGSL
CRAGEFRCSNGRCVPLTWLCDGEDDCQDNSDEKNCAQPTCGAGLFTCR
STNICISQVWVCDGVDDCEDNSDEDSCSAPASEPPGSL;

bKWD01_R1cM03mut04 (C3091)
(SEQ ID NO: 336)
CLPDEFQCGSGRCIPQHWLCDGLNDCGDGSDEPPAHCSAPASEPPGSL
CRAGEFRCSNGRCVPLTWLCDGEDDCQDNSDEKNCAQPTCGAGLFTCR
STNICISQAWVCDGVDDCEDNSDENYCSAPASEPPGSL;

bKWD01_R1cM03mut05 (C3092)
(SEQ ID NO: 337)
CLPDEFQCGSGRCIPQHWLCDGLNDCGDGSDEPPAHCSAPASEPPGSL
CRAGEFRCSNGRCVPLTWLCDGEDDCQDNSDEKNCAQPTCGAGLFTCR
STNICISQAWVCDGVDDCEDNSDETNCSAPASEPPGSL;

bKWD01_R1cM03mut06 (C3093)
(SEQ ID NO: 338)
CLPDEFQCGSGRCIPQHWLCDGLNDCGDGSDEPPAHCSAPASEPPGSL
CRAGEFRCSNGRCVPLTWLCDGEDDCQDNSDEKNCAQPTCGASLFTCR
RSNICISQAWVCDGVDDCEDNSDEMNCSAPASEPPGSL;

bKWD01_R1cM03mut09 (C3094)
(SEQ ID NO: 339)
CLPDEFQCGSGRCIPQHWLCDGLNDCGDGSDEPPAHCSAPASEPPGSL
CRAGEFRCSNGRCVPLTWLCDGEDDCQDNSDEKNCAQPTCGEGLFTCR
STNICISHAWVCDGVDDCEDNSDENNCSAPASEPPGSL;

bKWD01_R1cM23mut10 (C3095)
(SEQ ID NO: 340)
CLPDEFQCGSGRCIPQHWLCDGLNDCGDGSDEPPAHCSAPASEPPGSL
CRAGEFRCSNGRCVPLTWLCDGEDDCQDNSDEKNCAQPTCGANLFTCQ
SSNICISDAWVCDGVDDCEDNSDETTCSQDPEFHKV;

bKWD01_R1cM23mut11 (C3096)
(SEQ ID NO: 341)
CLPDEFQCGSGRCIPQHWLCDGLNDCGDGSDEPPAHCSAPASEPPGSL
CRAGEFRCSNGRCVPLTWLCDGEDDCQDNSDEKNCAQPTCGANLFTCR
STNICISPAWVCDGVDDCEDYSDEIGCSQDPEFHKV;

bKWD01_R1cM23mut14 (C3097)
(SEQ ID NO: 342)
CLPDEFQCGSGRCIPQHWLCDGLNDCGDGSDEPPAHCSAPASEPPGSL
CRAGEFRCSNGRCVPLTWLCDGEDDCQDNSDEKNCAQPTCGSDMFTCR
STNICISKVWVCDGVDDCEDDSDERGCSQDPEFHKV;

bKWD01_R1cM23mut15 (C3098)
(SEQ ID NO: 343)
CLPDEFQCGSGRCIPQHWLCDGLNDCGDGSDEPPAHCSAPASEPPGSL
CRAGEFRCSNGRCVPLTWLCDGEDDCQDNSDEKNCAQPTCGSNLFTCR
RTNICISKAWVCDGVDDCEDNSDETGCSQDPEFHKV;

bKWD01_R1cM23mut16 (C3099)
(SEQ ID NO: 344)
CLPDEFQCGSGRCIPQHWLCDGLNDCGDGSDEPPAHCSAPASEPPGSL
CRAGEFRCSNGRCVPLTWLCDGEDDCQDNSDEKNCAQPTCGSNLFTCR
STNICISPAWVCDGVDDCDDDSDETGCSQDPEFHKV;

bKWD01_R1cM23 mut17 (C3100)
(SEQ ID NO: 345)
CLPDEFQCGSGRCIPQHWLCDGLNDCGDGSDEPPAHCSAPASEPPGSL
CRAGEFRCSNGRCVPLTWLCDGEDDCQDNSDEKNCAQPTCGTNLFTCR
STNMCISQAWVCDGVDDCEDNSDETVCSQDPEFHKV;

bKWD03_R1cM15 (C3102)
(SEQ ID NO: 346)
CLPDEFQCGSGRCIPQTWVCDGLNDCGDGSDESPAHCSQDPEFHKVCR
PGEFRCNNGRCVPQTWVCDGEDDCGDNSDETDCSAPASEPPGSLCGAN
QFTCHNTNICISQAWVCDGVDDCEDNSDEKNCSAPASEPPGSL;

bKWD06_R1cM15 (C3103)
(SEQ ID NO: 347)
CLPDEFQCGSGRCIPQTWVCDGLNDCGDGSDESPAHCSQDPEFHKVCQ
PNEFQCGNGRCIPAQWLCDGEDDCQDNSDEEDCTEHTCGANQFTCHNT
NICISQAWVCDGVDDCEDNSDEKNCSAPASEPPGSL;

bKWD22_R1cM15 (C3104)
(SEQ ID NO: 348)
CPADEFRCSNTGRCVPLSWLCDGEDDCGDGSDETNCKAHTCPSNQFPC
RSTGICIPLAWVCDGLNDCGDGSDESPATCKAPVPTCGANQFTCHNTN
ICISQAWVCDGVDDCEDNSDEKNCSAPASEPPGSL;

bKWD29_R1cM15 (C3105)
(SEQ ID NO: 349)
CGADQFRCGNGSCVPRAWRCDGVDDCGDGSDEAPEICETPTCQSNEFR
CRSGRCIPQHWLCDGLNDCGDGSDESQQCSAPASEPPGSLCGANQFTC
HNTNICISQAWVCDGVDDCEDNSDEKNCSAPASEPPGSL;

bKWD06_R1cM03mut06 (C3192)
(SEQ ID NO: 350)
CLPDEFQCGSGRCIPQTWVCDGLNDCGDGSDESPAHCSQDPEFHKVCQ
PNEFQCGNGRCIPAQWLCDGEDDCQDNSDEEDCTEHTCGASLFTCRRS
NICISQAWVCDGVDDCEDNTDEMNCSAPASEPPGSL;

bKWD06_R1cM03mut09 (C3193)
(SEQ ID NO: 351)
CLPDEFQCGSGRCIPQTWVCDGLNDCGDGSDESPAHCSQDPEFHKVCQ
PNEFQCGNGRCIPAQWLCDGEDDCQDNSDEEDCTEHTCGEGLFTCRST
NICISHAWVCDGVDDCEDNSDENNCSAPASEPPGSL;

bKWD06_R1cM03mut11 (C3194)
(SEQ ID NO: 352)
CLPDEFQCGSGRCIPQTWVCDGLNDCGDGSDESPAHCSQDPEFHKVCQ
PNEFQCGNGRCIPAQWLCDGEDDCQDNSDEEDCTEHTCGANLFTCRST
NICISPAWVCDGVDDCEDYSDEIGCSQDPEFHKV;

bKWD06_R1cM03mut17 (C3195)
(SEQ ID NO: 353)
CLPDEFQCGSGRCIPQTWVCDGLNDCGDGSDESPAHCSQDPEFHKVCQ
PNEFQCGNGRCIPAQWLCDGEDDCQDNSDEEDCTEHTCGTNLFTCRST
NMCISQAWVCDGVDDCEDNSDETVCSQDPEFHKV;

bKWD22_R1cM03mut06 (C3196)
(SEQ ID NO: 354)
CPADEFRCSNTGRCVPLSWLCDGEDDCGDGSDETNCKAHTCPSNQFPC
RSTGICIPLAWVCDGLNDCGDGSDESPATCKAPVPTCGASLFTCRRSN
ICISQAWVCDGVDDCEDNSDEMNCSAPASEPPGSL;

bKWD22_R1cM03mut09 (C3197)
(SEQ ID NO: 355)
CPADEFRCSNTGRCVPLSWLCDGEDDCGDGSDETNCKAHTCPSNQFPC
RSTGICIPLAWVCDGLNDCGDGSDESPATCKAPVPTCGEGLFTCRSTN
ICISHAWVCDGVDDCEDNSDENNCSAPASEPPGSL;

bKWD22_R1cM03mut11 (C3198)
(SEQ ID NO: 356)
CPADEFRCSNTGRCVPLSWLCDGEDDCGDGSDETNCKAHTCPSNQFPC
RSTGICIPLAWVCDGLNDCGDGSDESPATCKAPVPTCGANLFTCRSTN
ICISPAWVCDGVDDCEDYSDEIGCSQDPEFHKV;

bKWD22_R1cM03mut17 (C3199)
(SEQ ID NO: 357)
CPADEFRCSNTGRCVPLSWLCDGEDDCGDGSDETNCKAHTCPSNQFPC
RSTGICIPLAWVCDGLNDCGDGSDESPATCKAPVPTCGTNLFTCRSTN
MCISQAWVCDGVDDCEDNSDETVCSQDPEFHKV;

bKWD29_R1cM03mut06 (C3200)
(SEQ ID NO: 358)
CGADQFRCGNGSCVPRAWRCDGVDDCGDGSDEAPEICETPTCQSNEFR
CRSGRCIPQHWLCDGLNDCGDGSDESQQCSAPASEPPGSLCGASLFTC
RRSNICISQAWVCDGVDDCEDNSDEMNCSAPASEPPGSL;

bKWD29_R1cM03mut09 (C3201)
(SEQ ID NO: 359)
CGADQFRCGNGSCVPRAWRCDGVDDCGDGSDEAPEICETPTCQSNEFR
CRSGRCIPQHWLCDGLNDCGDGSDESQQCSAPASEPPGSLCGEGLFTC
RSTNICISHAWVCDGVDDCEDNSDENNCSAPASEPPGSL;

bKWD29_R1cM03mut11 (C3202)
(SEQ ID NO: 360)
CGADQFRCGNGSCVPRAWRCDGVDDCGDGSDEAPEICETPTCQSNEFR
CRSGRCIPQHWLCDGLNDCGDGSDESQQCSAPASEPPGSLCGANLFTC
RSTNICISPAWVCDGVDDCEDYSDEIGCSQDPEFHKV;

bKWD29_R1cM03mut17 (C3203)
(SEQ ID NO: 361)
CGADQFRCGNGSCVPRAWRCDGVDDCGDGSDEAPEICETPTCQSNEFR
CRSGRCIPQHWLCDGLNDCGDGSDESQQCSAPASEPPGSLCGTNLFTC
RSTNMCISQAWVCDGVDDCEDNSDETVCSQDPEFHKV;

R1cM03mut06_bKWD22 (C3204)
(SEQ ID NO: 362)
CGASLFTCRRSNICISQAWVCDGVDDCEDNSDEMNCSAPASEPPGSLC
PADEFRCSNTGRCVPLSWLCDGEDDCGDGSDETNCKAHTCPSNQFPCR
STGICIPLAWVCDGLNDCGDGSDESPATCKAPVPT;

R1cM03mut09_bKWD22 (C3205)
(SEQ ID NO: 363)
CGEGLFTCRSTNICISHAWVCDGVDDCEDNSDENNCSAPASEPPGSLC
PADEFRCSNTGRCVPLSWLCDGEDDCGDGSDETNCKAHTCPSNQFPCR
STGICIPLAWVCDGLNDCGDGSDESPATCKAPVPT;

R1cM03mut11_bKWD22 (C3206)
(SEQ ID NO: 364)
CGANLFTCRSTNICISPAWVCDGVDDCEDYSDEIGCSQDPEFHKVCPA
DEFRCSNTGRCVPLSWLCDGEDDCGDGSDETNCKAHTCPSNQFPCRST
GICIPLAWVCDGLNDCGDGSDESPATCKAPVPT;

R1cM03mut17_bKWD22 (C3207)
(SEQ ID NO: 365)
CGTNLFTCRSTNMCISQAWVCDGVDDCEDNSDETVCSQDPEFHKVCPA
DEFRCSNTGRCVPLSWLCDGEDDCGDGSDETNCKAHTCPSNQFPCRST
GICIPLAWVCDGLNDCGDGSDESPATCKAPVPT;

R1cM03mut06_bKWD29 (C3208)
(SEQ ID NO: 366)
CGASLFTCRRSNICISQAWVCDGVDDCEDNSDEMNCSAPASEPPGSLC
GADQFRCGNGSCVPRAWRCDGVDDCGDGSDEAPEICETPTCQSNEFRC
RSGRCIPQHWLCDGLNDCGDGSDESQQCSAPASEPPGSL;

R1cM03mut09_bKWD29 (C3209)
(SEQ ID NO: 367)
CGEGLFTCRSTNICISHAWVCDGVDDCEDNSDENNCSAPASEPPGSLC
GADQFRCGNGSCVPRAWRCDGVDDCGDGSDEAPEICETPTCQSNEFRC
RSGRCIPQHWLCDGLNDCGDGSDESQQCSAPASEPPGSL;

R1cM03mut11_bKWD29 (C3210)
(SEQ ID NO: 368)
CGANLFTCRSTNICISPAWVCDGVDDCEDYSDEIGCSQDPEFHKVCGA
DQFRCGNGSCVPRAWRCDGVDDCGDGSDEAPEICETPTCQSNEFRCRS
GRCIPQHWLCDGLNDCGDGSDESQQCSAPASEPPGSL;

R1cM03mut17_bKWD29 (C3211)
(SEQ ID NO: 369)
CGTNLFTCRSTNMCISQAWVCDGVDDCEDNSDETVCSQDPEFHKVCGA
DQFRCGNGSCVPRAWRCDGVDDCGDGPDEAPEICETPTCQSNEFRCRS
GRCIPQHWLCDGLNDCGDGSDESQQCSAPASEPPGSL;

R1cM03_BKWD01 (C2737)
(SEQ ID NO: 370)
CGAGLFTCRSTKICISQAWVCDGVDDCEDNSDEKNCSAPASEPPGSLC
LPDEFQCGSGRCIPQHWLCDGLNDCGDGSDEPPAHCSAPASEPPGSLC
RAGEFRCSNGRCVPLTWLCDGEDDCQDNSDEKNCAQPT;

R1cM03_BKWD02 (C2738)
(SEQ ID NO: 371)
CGAGLFTCRSTKICISQAWVCDGVDDCEDNSDEKNCSAPASEPPGSLC
LPDEFQCSSGRCIPQTWVCDGLNDCGDGSDESPAHCSQDPEFHKVCPS
SEFRCNNGRCIPLHWVCDGDDDCQDNSDETDCERSGRT;

BKWD02_R1cM03 (C2739)
(SEQ ID NO: 372)
CLPDEFQCSSGRCIPQTWVCDGLNDCGDGSDESPAHCSQDPEFHKVCP
SSEFRCNNGRCIPLHWVCDGDDDCQDNSDETDCERSGRTCGAGLFTCR
STKICISQAWVCDGVDDCEDNSDEKNCSAPASEPPGSL;

R1cM03_BKWD25 (C2740)
(SEQ ID NO: 373)
CGAGLFTCRSTKICISQAWVCDGVDDCEDNSDEKNCSAPASEPPGSLC
GPDEFRCNNGQCIPLPWRCDGVDDCGDNSDEPLEICQAPTCQSNEFRC
RSGRCIPQHWLCDGLNDCGDGSDEPPAHCSAPASEPPGSL;

R1cM08_BKWD01 (C2741)
(SEQ ID NO: 374)
CGAGQFTCRDTNICISRAWRCDGVDDCEDNSDEADCSQDPEFHKVCLP
DEFQCGSGRCIPQHWLCDGLNDCGDGSDEPPAHCSAPASEPPGSLCRA
GEFRCSNGRCVPLTWLCDGEDDCQDNSDEKNCAQPT;

BKWD01_R1cM08 (C2742)
(SEQ ID NO: 375)
CLPDEFQCGSGRCIPQHWLCDGLNDCGDGSDEPPAHCSAPASEPPGSL
CRAGEFRCSNGRCVPLTWLCDGEDDCQDNSDEKNCAQPTCGAGQFTCR
DTNICISRAWRCDGVDDCEDNSDEADCSQDPEFHKV;

R1cM08_BKWD02 (C2743)
(SEQ ID NO: 376)
CGAGQFTCRDTNICISRAWRCDGVDDCEDNSDEADCSQDPEFHKVCLP
DEFQCSSGRCIPQTWVCDGLNDCGDGSDESPAHCSQDPEFHKVCPSSE
FRCNNGRCIPLHWVCDGDDDCQDNSDETDCERSGRT;

BKWD02_R1cM08 (C2744)
(SEQ ID NO: 377)
CLPDEFQCSSGRCIPQTWVCDGLNDCGDGSDESPAHCSQDPEFHKVCP
SSEFRCNNGRCIPLHWVCDGDDDCQDNSDETDCERSGRTCGAGQFTCR
DTNICISRAWRCDGVDDCEDNSDEADCSQDPEFHKV;

R1cM08_BKWD25 (C2745)
(SEQ ID NO: 378)
CGAGQFTCRDTNICISRAWRCDGVDDCEDNSDEADCSQDPEFHKVCGP
DEFRCNNGQCIPLPWRCDGVDDCGDNSDEPLEICQAPTCQSNEFRCRS
GRCIPQHWLCDGLNDCGDGSDEPPAHCSAPASEPPGSL;

R1cM15_BKWD01 (C2747)
(SEQ ID NO: 379)
CGANQFTCHNTNICISQAWVCDGVDDCEDNSDEKNCSAPASEPPGSLC
LPDEFQCGSGRCIPQHWLCDGLNDCGDGSDEPPAHCSAPASEPPGSLC
RAGEFRCSNGRCVPLTWLCDGEDDCQDNSDEKNCAQPT;

R1cM31_BKWD25 (C2748)
(SEQ ID NO: 380)
CLSDQFTCRSTNICLPLQWVCDGDDDCEDNSDEEDCSAPASEPPGSLC
GPDEFRCNNGQCIPLPWRCDGVDDCGDNSDEPLEICQAPTCQSNEFRC
RSGRCIPQHWLCDGLNDCGDGSDEPPAHCSAPASEPPGSL;

R1cM15_BKWD02 (C2749)
(SEQ ID NO: 381)
CGANQFTCHNTNICISQAWVCDGVDDCEDNSDEKNCSAPASEPPGSLC
LPDEFQCSSGRCIPQTWVCDGLNDCGDGSDESPAHCSQDPEFHKVCPS
SEFRCNNGRCIPLHWVCDGDDDCQDNSDETDCERSGRT;

BKWD02_R1cM15 (C2750)
(SEQ ID NO: 382)
CLPDEFQCSSGRCIPQTWVCDGLNDCGDGSDESPAHCSQDPEFHKVCP
SSEFRCNNGRCIPLHWVCDGDDDCQDNSDETDCERSGRTCGANQFTCH
NTNICISQAWVCDGVDDCEDNSDEKNCSAPASEPPGSL;

R1cM15_BKWD25 (C2751)
(SEQ ID NO: 383)
CGANQFTCHNTNICISQAWVCDGVDDCEDNSDEKNCSAPASEPPGSLC
GPDEFRCNNGQCIPLPWRCDGVDDCGDNSDEPLEICQAPTCQSNEFRC
RSGRCIPQHWLCDGLNDCGDGSDEPPAHCSAPASEPPGSL;

BKWD01_R1cM23 (C2752)
(SEQ ID NO: 384)
CLPDEFQCGSGRCIPQHWLCDGLNDCGDGSDEPPAHCSAPASEPPGSL
CRAGEFRCSNGRCVPLTWLCDGEDDCQDNSDEKNCAQPTCGSNQFTCR
STNICISQAWVCDGVDDCEDDSDETGCSQDPEFHKV;

R1cM23_BKWD02 (C2753)
(SEQ ID NO: 385)
CGSNQFTCRSTNICISQAWVCDGVDDCEDDSDETGCSQDPEFHKVCLP
DEFQCSSGRCIPQTWVCDGLNDCGDGSDESPAHCSQDPEFHKVCPSSE
FRCNNGRCIPLHWVCDGDDDCQDNSDETDCERSGRT;

BKWD02_R1cM23 (C2754)
(SEQ ID NO: 386)
CLPDEFQCSSGRCIPQTWVCDGLNDCGDGSDESPAHCSQDPEFHKVCP
SSEFRCNNGRCIPLHWVCDGDDDCQDNSDETDCERSGRTCGSNQFTCR
STNICISQAWVCDGVDDCEDDSDETGCSQDPEFHKV;

BKWD01_R1cM31 (C2757)
(SEQ ID NO: 387)
CLPDEFQCGSGRCIPQHWLCDGLNDCGDGSDEPPAHCSAPASEPPGSL
CRAGEFRCSNGRCVPLTWLCDGEDDCQDNSDEKNCAQPTCLSDQFTCR
STNICLPLQWVCDGDDDCEDNSDEEDCSAPASEPPGSL;

BKWD05_R1cM08 (C2792)
(SEQ ID NO: 388)
CAAGQFRCHNSDTCLPGAWVCDGDNDCGDNSDEASCQKRTCHSFNQFE
CRNGQCIPLHLVCDGVPDCGDNSDETDCGDSHILPFSTPGPSTCGAGQ
FTCRDTNICISRAWRCDGVDDCEDNSDEADCSQDPEFHKV;

BKWD06_R1cM08 (C2793)
(SEQ ID NO: 389)
CAPDQFRCSSGQCIPETWLCDGDDDCVDSSDEAGCASTVPTCLPDEFQ
CGSGRCIPQTWVCDGLNDCGDGSDESPAHCSQDPEFHKVCGAGQFTCR
DTNICISRAWRCDGVDDCEDNSDEADCSQDPEFHKV;

BKWD01_R1cM15 (C2794)
(SEQ ID NO: 390)
CLPDEFQCGSGRCIPQHWLCDGLNDCGDGSDEPPAHCSAPASEPPGSL
CRAGEFRCSNGRCVPLTWLCDGEDDCQDNSDEKNCAQPTCGANQFTCH
NTNICISQAWVCDGVDDCEDNSDEKNCSAPASEPPGSL;

R1cM15_BKWD31 (C2795)
(SEQ ID NO: 391)
CGANQFTCHNTNICISQAWVCDGVDDCEDNSDEKNCSAPASEPPGSLC
LPDEFRCGNGNCISVAWRCDGVDDCEDGSDEEDCESPEHTCQSNEFRC
RSGRCIPQHWLCDGLNDCGDGSDESPAHCSQDPEFHKV;

R1cM15_BKWD06 (C2796)
(SEQ ID NO: 392)
CGANQFTCHNTNICISQAWVCDGVDDCEDNSDEKNCSAPASEPPGSLC
APDQFRCSSGQCIPETWLCDGDDDCVDSSDEAGCASTVPTCLPDEFQC
GSGRCIPQTWVCDGNDCGDGSDESPAHCSQDPEFHKV;

-continued bKWD02_R1cM03mutM09 (C4168)
(SEQ ID NO: 1265)
CLPDEFQCSSGRCIPQTWVCDGLNDCGDGSDESPAHCSQDPEFHKVCP
SSEFRCNNGRCIPLHWVCDGDDDCQDNSDETDCAQPTCGEGLFTCRST
NICISHAWVCDGVDDCEDNSDENNCSAPASEPPGSL;

bKWD03_R1cM03mutM09 (C4169)
(SEQ ID NO: 1266)
CLPDEFQCGSGRCIPQTWVCDGLNDCGDGSDESPAHCSQDPEFHKVCR
PGEFRCNNGRCVPQTWVCDGEDDCGDNSDETDCAQPTCGEGLFTCRST
NICISHAWVCDGVDDCEDNSDENNCSAPASEPPGSL;

bKWD04_R1cM03mutM09 (C4170)
(SEQ ID NO: 1267)
CLPDEFQCGSGRCIPQTWVCDGLNDCGDGSDESPAHCSQDPEFHKVCL
SDQFRCGNGRCVPRAWLCDGDNDCQDGSDETNCEQPTCGEGLFTCRST
NICISHAWVCDGVDDCEDNSDENNCSAPASEPPGSL;

bKWD05_R1cM03mutM09 (C4171)
(SEQ ID NO: 1268)
CLPDEFQCGSGRCIPQTWVCDGLNDCGDGSDESPAHCSQDPEFHKVCL
PGQFPCGNGRCIPETWLCDGDDDCQDGSDEKGCAQPTCGEGLFTCRST
NICISHAWVCDGVDDCEDNSDENNCSAPASEPPGSL;

bKWD08_R1cM03mutM09 (C4173)
(SEQ ID NO: 1269)
CLPDEFQCGSGRCIPQTWVCDGLNDCGDGSDESPAHCSQDPEFHKVCQ
SNEFRCRNGQCIPLTWLCDGDNDCLDSSDEESCPAHTCGEGLFTCRST
NICISHAWVCDGVDDCEDNSDENNCSAPASEPPGSL;

bKWD21_R1cM03mutM09 (C4174)
(SEQ ID NO: 1270)
CAPGEFTCKNTGRCIPLNWRCDGDDDCGDGSDETDCPAPTCPSNQFPC
RSTGICIPLAWVCDGLNDCGDGSDESPAHCSAPASEPPGSLCGEGLFT
CRSTNICISHAWVCDGVDDCEDNSDENNCSAPASEPPGSL;

bKWD25_R1cM03mutM09 (C4176)
(SEQ ID NO: 1271)
CGPDEFRCNNGQCIPLPWRCDGVDDCGDNSDEPLEICQAPTCQSNEFR
CRSGRCIPQHWLCDGLNDCGDGSDEPPAHCSAPASEPPGSLCGEGLFT
CRSTNICISHAWVCDGVDDCEDNSDENNCSAPASEPPGSL;

bKWD28_R1cM03mutM09 (C4177)
(SEQ ID NO: 1272)
CGANEFQCRSTGICVPVEWVCDGDNDCGDGSDEPPVCGDSHILPFSTP
GPSTCQPDEFTCSSGRCIPQPWLCDGLNDCGDGSDEPPAHCSAPASEP
PGSLCGEGLFTCRSTNICISHAWVCDGVDDCEDNSDENNCSAPASEPP
GSL;

R1cM03mutM09_bKWD01 (C4178)
(SEQ ID NO: 1273)
CGEGLFTCRSTNICISHAWVCDGVDDCEDNSDENNCSAPASEPPGSLC
LPDEFQCGSGRCIPQHWLCDGLNDCGDGSDEPPAHCSAPASEPPGSLC
RAGEFRCSNGRCVPLTWLCDGEDDCQDNSDEKNCAQPT;

LNRM01_R1cM03mutM09 (C4311)
(SEQ ID NO: 1274)
CIAAKLCEALDGDGVCHKECDLEECDWDGGDCQRIFLTDPTCGEGLFT
CRSTNICISHAWVCDGVDDCEDNSDENNCSAPASEPPGSL;
and R1cM03mutM09_LNRM01 (C4312)
(SEQ ID NO: 1275)
CGEGLFTCRSTNICISHAWVCDGVDDCEDNSDENNCSAPASEPPGSLC
IAAKLCEALDGDGVCHKECDLEECDWDGGDCQRIFLTDPT IV. Improving Serum Half-Life The present disclosure further provides monomer domains that bind (e.g., selectively bind) to a blood factor (e.g., serum albumin, immunoglobulin, or to erythrocytes). In some embodiments, the monomers disclosed herein will bind to a blood factor with an affinity of less than $10^{-3}$ M (i.e., binds stronger than an affinity of $10^{-3}$ M). In some embodiments, the affinity (i.e., $K_D$) is less than $10^{-4}$ M, $10^{-5}$ M, $10^{-6}$ M, $10^{-7}$ M, $10^{-8}$ M or $10^{-9}$ M.

In some embodiments, the monomer domains bind to an immunoglobulin polypeptide or a portion thereof.

Thus, the present disclosure provides a method for extending the serum half-life of a binding protein, including, e.g., a multimer or a protein of interest, in an animal, including humans. In one embodiment, the method comprises first providing a monomer domain that has been identified as a binding protein that specifically binds to a half-life extender such as a blood-carried molecule or cell, such as serum albumin (e.g., human serum albumin), IgG, red blood cells, etc. The half-life extender-binding monomer is then covalently linked to another monomer domain that has a binding affinity for a protein of interest (e.g., FGFR1c, β-Klotho or both FGFR1c and β-Klotho, or a different target). This complex formation results in the half-life extension protecting the multimer and/or bound protein(s) from proteolytic degradation and/or other removal of the multimer and/or protein(s) and thereby extending the half-life of the protein and/or multimer. One variation of this use of the binding proteins disclosed herein includes the half-life extender-binding monomer covalently linked to the protein of interest. The protein of interest can include a monomer domain, a multimer of monomer domains, or a synthetic drug. Alternatively, monomers that bind to either immunoglobulins or erythrocytes can be generated using the above method and could be used for half-life extension.

Half-life extender-binding multimers are typically multimers of at least two domains, chimeric domains, or mutagenized domains (e.g., one that binds to FGFR1c, one that binds to β-Klotho, or one of each type of monomer, and one that binds to the blood-carried molecule or cell). Suitable domains include all of those described herein, that are further screened and selected for binding to a half-life extender. The half-life extender-binding multimers are generated in accordance with the methods for making multimers described herein, using, for example, monomer domains pre-screened for half-life extender-binding activity. The serum half-life of a molecule can be extended to be, e.g., at least 1, 2, 3, 4, 5, 10, 20, 30, 40, 50, 60, 70, 80, 90, 100, 150, 200, 250, 400, 500 or more hours.

Half-life extending monomer domain(s) can be linked to the N-, C-terminus or both the N- and C-termini of a binding protein (e.g., a protein comprising FGFR1c-, β-Klotho- or both FGFR1c and β-Klotho-binding monomer domain).

In some embodiments the multimer can be covalently linked to the N- or C-terminus of human serum albumin or to the N- or C-terminus of the Fc domain of immunoglobulin G. Such fusions have enhanced serum half-life as a result of passing through the FcRn scavenger pathway in the endothelium that is used by native endogenous serum albumin and IgG. The serum half-life of a molecule can be extended to be, e.g., at least 1, 2, 3, 4, 5, 10, 20, 30, 40, 50, 60, 70, 80, 90, 100, 150, 200, 250, 400, 500 or more hours.

In some embodiments N-terminal sequences are added to the binding protein to permit addition of polyethylene glycol (PEG) moieties via amide linkage chemistry. Addition of PEG increases the hydrodynamic radius of the binding protein, thus reducing excretion via kidney filtration. PEG molecules available for such purposes come in a range of molecular weights and as either linear or branched molecules.

V. Multimers

Methods for generating multimers form another aspect of the present disclosure. Multimers, which comprise some of the binding proteins described herein, comprise at least two monomer domains (e.g., a domain that binds to FGFR1c and a domain that binds to β-Klotho, two domains that bind β-Klotho or two domains that bind FGFR1c). For example, multimers can comprise from 2 to about 10 monomer domains, from 2 and about 8 monomer domains, from about 3 and about 10 monomer domains, about 7 monomer domains, about 6 monomer domains, about 5 monomer domains, or about 4 monomer domains. In some embodiments, the multimer comprises 3 or at least 3 monomer domains. In some embodiments, the multimers have no more than 2, 3, 4, 5, 6, 7, or 8 monomer domains. In view of the possible range of monomer domain sizes, the multimers can be, e.g., less than 100 kD, less than 90 kD, less than 80 kD, less than 70 kD, less than 60 kD, less than 50 kD, less than 40 kD, less than 30 kD, less than 25 kD, less than 20 kD, less than 15 kD, less than 10 kD or can be smaller or larger. In some cases, the monomer domains have been pre-selected for binding to a target molecule of interest (e.g., FGFR1c or β-Klotho). In some embodiments, the multimers will bind to FGFR1c, β-Klotho or both FGFR1c and β-Klotho (or, e.g., a blood factor such as HSA or IgG) with an affinity of less than $10^{-3}$ M (i.e., binds stronger than an affinity of $10^{-3}$ M). In some embodiments, the affinity is less than $10^{-4}$ M, $10^{-5}$ M, $10^{-6}$ M, $10^{-7}$ M, $10^{-8}$ M, $10^{-9}$ M, or $10^{-10}$ M. In some embodiments, the affinity of a multimer will be stronger (less) than the sum of affinities of the respective monomer domains in the multimer.

In some embodiments, each monomer domain specifically binds to one target molecule (e.g., FGFR1c or β-Klotho), while in other embodiments each monomer binds to the same target molecule (e.g., β-Klotho or FGFR1c), possibly at different locations on the same target protein. In some of these embodiments, each monomer binds to a different position (analogous to an epitope) on a target molecule. Multiple monomer domains that bind to the same target molecule results in an avidity effect resulting in improved affinity of the multimer for the target molecule compared to the affinity of each individual monomer. In some embodiments, the multimer has an affinity of at least about 1.5, 2, 3, 4, 5, 10, 20, 50, 100, 200, 500, or 1000 times the affinity of a monomer domain alone. In some embodiments, at least one, two, three, four or more (e.g., all) monomers of a multimer bind an ion such as calcium or another ion.

Multimers can comprise a variety of combinations of monomer domains. For example, in a single multimer, the monomer domains can be identical (e.g., two or more identical domains that bind to FGFR1c, or two or more identical domains that bind to β-Klotho) or different (e.g., one or more domains that binds to FGFR1c and one or more domain(s) that bind to β-Klotho). In addition, the selected monomer domains can comprise various different monomer domains from the same monomer domain family, or various monomer domains from different domain families, or optionally, a combination of both. For example, the monomer domains can be selected from Families 1-3 of FGFR1c-binding monomer domains or Families 4-10 of the β-Klotho-binding monomer domains. In some embodiments, at least one of the monomer domains is selected from Families 1-3 (FGFR1c-binding monomers) and another monomer domain is selected from Families 4-10 (β-Klotho-binding monomers). Exemplary FGFR1c-, β-Klotho- and bispecific FGFR1c- and β-Klotho-binding dimers are provided herein.

Additional examples of multimers that can be generated include the following:

(1) A homo-multimer (a multimer of the same domain, i.e., A1-A1-A1-A1);

(2) A hetero-multimer of different domains of the same domain class, e.g., A1-A2-A3-A4. For example, hetero-multimer include multimers where A1, A2, A3 and A4 are different recombinant variants of a particular LDL-receptor class A domains, or where some of A1, A2, A3, and A4 are non-recombinant variants of a LDL-receptor class A domain.

(3) A hetero-multimer of domains from different monomer domain classes, e.g., A1-B2-A2-B1. For example, where A1 and A2 are two different monomer domains (either recombinant or non-recombinant) from LDL-receptor class A, and B1 and B2 are two different monomer domains (either recombinant or non-recombinant) from class EGF-like domain).

In another embodiment, the multimer comprises monomer domains with specificities for different target molecules (e.g., a blood factor such as serum albumin, immunoglobulin, or erythrocytes). For example, in some embodiments, the multimers comprise 1, 2, 3, or more monomer domains that bind to FGFR1c, β-Klotho or both FGFR1c and β-Klotho, and at least one monomer domain that binds to a second target molecule. Exemplary target molecules include, e.g., a serum molecule that extends the serum half-life of the multimer (e.g., an immunoglobulin or serum albumin). Exemplary molecules that extend the serum half-life of a multimer include, e.g., red blood cells (i.e., erythrocytes), IgG, and serum albumin such as HSA. An example of a multimer can include, e.g., a monomer domain from Families 1-3 of the FGFR1c binding domains and a monomer from Families 4-19 of the β-Klotho-binding domains (and optionally 2, 3, 4, or more FGFR1c and/or β-Klotho binding domains) and an immunoglobulin binding monomer domain.

Multimer libraries can contain homo-multimers, hetero-multimers of different monomer domains of the same monomer class, or hetero-multimers of monomer domains from different monomer classes, or combinations thereof.

Monomer domains, as described herein, can also be readily employed in an immuno-domain-containing heteromultimer (i.e., a multimer that has at least one immuno-domain variant and one monomer domain variant). Thus, multimers can have at least one immuno-domain such as a minibody, a single-domain antibody, a single chain variable fragment (ScFv), or a Fab fragment; and at least one monomer domain, such as, for example, an EGF-like domain, a Kringle-domain, a fibronectin type I domain, a fibronectin type II domain, a fibronectin type III domain, a PAN domain, a Gla domain, a SRCR domain, a Kunitz/Bovine pancreatic trypsin Inhibitor domain, a Kazal-type serine protease inhibitor domain, a Trefoil (P-type) domain, a von Willebrand factor type C domain, an Anaphylatoxin-like domain, a CUB domain, a thyroglobulin type I repeat, LDL-receptor class A domain, a Sushi domain, a Link domain, a Thrombospondin type I domain, an Immunoglobulin-like domain, a C-type lectin domain, a MAM domain, a von Willebrand factor type A domain, a Somatomedin B domain, a WAP-type four disulfide core domain, a F5/8 type C domain, a Hemopexin domain, an SH2 domain, an SH3 domain, a Laminin-type EGF-like domain, a C2 domain, or variants thereof.

Figure 8:
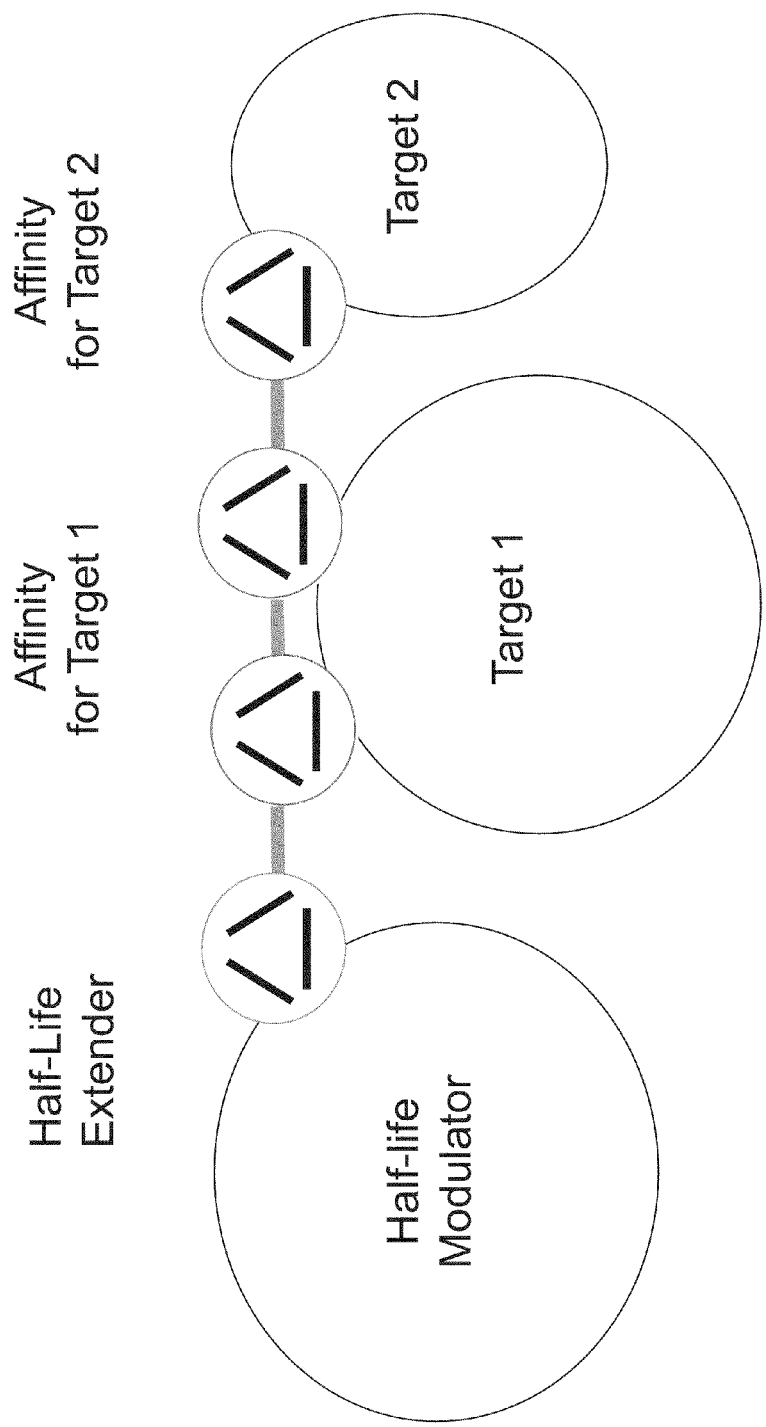
FIG. 8 is a cartoon depicting a possible conformation of a multimer of the present disclosure comprising at least one monomer domain that binds to a half-life extending molecule and one or more monomer domains binding to one or more target molecules (e.g., β-Klotho and FGFR1c). In the Figure, two monomer domains bind to a first target molecule (Target 1) and one monomer domain binds to a second target molecule (Target 2); the monomer domain that binds to a half-life extending molecule can be placed at either the N- or C-terminus of the multimer.

Domains need not be selected before the domains are linked to form multimers. On the other hand, the domains can be selected for the ability to bind to a target molecule before being linked into multimers. Thus, for example, a multimer can comprise two domains that bind to one target molecule (e.g., β-Klotho) and a third domain that binds to a second target molecule (e.g., FGFR1c), and a fourth domain that binds to a half-life modulator domain. See FIG. 8.

Multimers can have one or more of the following qualities: multivalent, multispecific, single chain, heat stable, extended serum and/or shelf half-life. Moreover none, one, more than one or all of the monomer domains can bind an ion (e.g., a metal ion or a calcium ion), none, one, more than one or all of the monomer domains can be derived from LDL receptor A domains and/or EGF-like domains, at least one, more than one or all of the monomer domains can be recombinant, and/or at least one, more than one or all of the monomer domains can comprise 1, 2, 3, or 4 disulfide bonds per monomer domain. In some embodiments, the multimers comprise at least two (or at least three) monomer domains, wherein at least one monomer domain is a recombinant monomer domain and the monomer domains bind calcium. In some embodiments, the multimers comprise at least 4 monomer domains, wherein at least one monomer domain is recombinant, and wherein:

a. each monomer domain is between 30-100 amino acids and each of the monomer domains comprise at least one disulfide linkage; or b. each monomer domain is between 30-100 amino acids and is derived from an extracellular protein; or c. each monomer domain is between 30-100 amino acids and binds to a protein target.

In some embodiments, the multimers comprise at least 4 monomer domains, wherein at least one monomer domain is recombinant, and wherein:

a. each monomer domain is between 35-100 amino acids; or b. each domain comprises at least one disulfide bond and is derived from a human protein and/or an extracellular protein.

In some embodiments, the multimers comprise at least two monomer domains, wherein at least one monomer domain is recombinant, and wherein each domain is:

a. 25-50 amino acids long and comprises at least one disulfide bond; or b. 25-50 amino acids long and is derived from an extracellular protein; or c. 25-50 amino acids and binds to a protein target; or d. 35-50 amino acids long.

In some embodiments, the multimers comprise at least two monomer domains, wherein at least one monomer domain is recombinant and:

a. each monomer domain comprises at least one disulfide bond; or b. at least one monomer domain is derived from an extracellular protein; or c. at least one monomer domain binds to a target protein.

Monomer domains and/or multimers identified can have biological activity, which is meant to include at least selective binding of a selected or desired ligand or target, and, in some instances, will further include the ability to block the binding of other compounds, to stimulate or inhibit a metabolic pathway, to act as a signal or messenger, to stimulate or inhibit cellular activity, and the like. In some embodiments, one or more of the monomer domains of the binding proteins provided herein bind to FGFR1c or β-Klotho or both FGFR1c and β-Klotho. In some embodiments, the binding of one or more monomer domains either block the binding of other molecules to FGFR1c or β-Klotho or, significantly and as shown in the Examples provided herein, mimic the in vivo activity of FGF21 and consequently activate FGF21-mediated signaling events.

A single ligand can be used, or optionally a variety of ligands can be used to select the monomer domains and/or multimers. A monomer domain can bind a single ligand or a variety of ligands. A multimer of the present invention can have multiple discrete binding sites for a single ligand, or optionally, can have multiple binding sites for a variety of ligands.

In some embodiments, the multimers bind to the same or other multimers to form aggregates. Aggregation can be mediated, for example, by the presence of hydrophobic domains on two monomer domains, resulting in the formation of non-covalent interactions between two monomer domains. Alternatively, aggregation may be facilitated by one or more monomer domains in a multimer having binding specificity for a monomer domain in another multimer. Aggregates can also form due to the presence of affinity peptides on the monomer domains or multimers. Aggregates can contain more target molecule binding domains than a single multimer.

Multimers with affinity for both a cell surface target (e.g., β-Klotho or FGFR1c) and a second target may provide for increased avidity effects. In some cases, membrane fluidity can be more flexible than protein linkers in optimizing (by self-assembly) the spacing and valency of the interactions. In some cases, multimers will bind to two different targets, each on a different cell or one on a cell and another on a molecule with multiple binding sites.

In some embodiments, the monomers or multimers disclosed herein are linked to another polypeptide to form a fusion protein. Any polypeptide can be used as a fusion partner, though it can be desirable if the fusion partner forms multimers. For example, monomers or multimers can, for example, be fused to the following locations or combinations of locations of an antibody:

1. At the N-terminus of the VH1 and/or VL1 domains, optionally just after the leader peptide and before the domain starts (framework region 1);

2. At the N-terminus of the CH1 or CL1 domain, replacing the VH1 or VL1 domain;

3. At the N-terminus of the heavy chain, optionally after the CH1 domain and before the cysteine residues in the hinge (Fc-fusion);

4. At the N-terminus of the CH3 domain;

5. At the C-terminus of the CH3 domain, optionally attached to the last amino acid residue via a short linker;

6. At the C-terminus of the CH2 domain, replacing the CH3 domain;

7. At the C-terminus of the CL1 or CH1 domain, optionally after the cysteine that forms the interchain disulfide; or 8. At the C-terminus of the VH1 or VL1 domain.

In some embodiments, one or more monomer or multimer domains, such as those described herein, is linked to a molecule (e.g., a protein, nucleic acid, organic small molecule, etc.) to form a pharmaceutical. Exemplary pharmaceutical proteins suitable for fusion with a binding protein include, e.g., cytokines, antibodies, chemokines, growth factors, interleukins, cell-surface proteins (e.g., FGFR1c or β-Klotho), extracellular domains, cell surface receptors, cytotoxins, etc. Exemplary small molecule pharmaceuticals include toxins or therapeutic agents. In some embodiments, a metal can be bound to the binding proteins disclosed herein. This can be useful, e.g., as a contrast agent for use in MRI.

In some embodiments a Human Serum Albumin (HSA) polypeptide is fused to the N- or C-terminus of a monomer or multimer. As described herein, a heterologous sequence can be an amino acid sequence or a non-amino acid-containing polymer. A HSA sequence(s) can be fused either directly to the monomer or multimer or via a linker or adapter molecule. A linker or adapter molecule can be one or more amino acid residues (or -mers), e.g., 1, 2, 3, 4, 5, 6, 7, 8, or 9 residues (or -mers), preferably from 10 to 50 amino acid residues (or -mers), e.g., 10, 11, 12, 13, 14, 15, 16, 17, 18, 19, 20, 25, 30, 35, 40, 45, or 50 residues (or -mers), and more preferably from 15 to 35 amino acid residues (or -mers). A linker or adapter molecule can also be designed with a cleavage site for a DNA restriction endonuclease or for a protease to allow for the separation of the fused moieties.

In some embodiments, the monomer or multimers are selected to bind to a tissue- or disease-specific target protein. Tissue-specific proteins are proteins that are expressed exclusively, or at a significantly higher level, in one or several particular tissue(s) compared to other tissues in an animal.

In some embodiments, the monomers or multimers that bind to one or more target proteins are linked to a pharmaceutical protein or small molecule such that the resulting complex or fusion is targeted to the specific tissue or disease-related cell(s) where the target protein (e.g., FGFR1c or β-Klotho) is expressed. Monomers or multimers for use in such complexes or fusions can be initially selected for binding to the target protein and can be subsequently selected by negative selection against other cells or tissue (e.g., to avoid targeting bone marrow or other tissues that set the lower limit of drug toxicity) where it is desired that binding be reduced or eliminated in other non-target cells or tissues. By keeping the pharmaceutical away from sensitive tissues, the therapeutic window is increased so that a higher dose can be administered safely. In another alternative, in vivo panning can be performed in animals by injecting a library of monomers or multimers into an animal and then isolating the monomers or multimers that bind to a particular tissue or cell of interest.

The binding proteins described herein can also include a linker peptide between the pharmaceutical protein and the monomer or multimers. A peptide linker sequence can be employed to separate, for example, the polypeptide components by a distance sufficient to ensure that each polypeptide folds into its secondary and tertiary structures. Fusion proteins can generally be prepared using standard techniques, including chemical conjugation. Fusion proteins can also be expressed as recombinant proteins in an expression system by standard techniques.

Multimers or monomer domains can be produced according to any methods known in the art. In some embodiments, E. coli comprising a plasmid encoding the polypeptides under transcriptional control of an inducible promoter is used to express the protein. After harvesting the bacteria, they can be lysed by mechanical methods such as sonication and homogenization, chemical extraction with detergent or by the application of heat, and then clarified by centrifugation.

The polypeptides can be purified using Ni-NTA agarose elution (if 6×His (SEQ ID NO: 393) tagged) or DEAE sepharose elution (if untagged) and refolded, such as by dialysis. Misfolded proteins can be neutralized by capping free sulfhydryls with iodoacetic acid. Q sepharose elution, phenyl sepharose flow-through, butyl sepharose flow-through, SP sepharose elution, DEAE sepharose elution, and/or CM sepharose elution can be used to purify the polypeptides. Equivalent anion and/or cation exchange purification steps can also be employed.

In some embodiments, monomers or multimers can be purified using heat lysis, typically followed by a fast cooling to prevent most proteins from renaturing. Due to the heat stability of the proteins disclosed herein, the desired proteins will not be denatured by the heat and therefore will allow for a purification step resulting in high purity. In some embodiments, a continuous flow heating process to purify the monomers or multimers from bacterial cell cultures is used. For example, a cell suspension can be passed through a stainless steel coil submerged in a water bath set to a temperature resulting in lysis of the bacteria (e.g., about 65-100 degrees C.). The lysed effluent is routed to a cooling bath to obtain rapid cooling and prevent renaturation of denatured E. coli proteins. E. coli proteins denature and are prevented from renaturing, but the monomer or multimers do not denature under these conditions due to the exceptional stability of their scaffold. The heating time can be controlled by adjusting the flow rate and length of the coil. This approach yields active proteins with high yield and exceptionally high purity (e.g., >80%, >85%, >90%, >95%, >96%, >97%, >98%, or >99%) compared to alternative approaches and is amenable to large scale production of clinical material.

In some embodiments, following the generation of the monomers or multimers described herein, the binding proteins are stored in a solution comprising iodoacetic acid to prevent scrambling of disulfide bind linkages. In some embodiments, 0.1-100 mM (e.g., 1-10 mM) iodoacetic acid is included in the solutions for storage. If desired, the iodoacetic acid can be removed before administered to an individual.

In some embodiments, the polypeptide comprising a monomer or multimer is linked to itself (C-terminus to N-terminus), e.g., for protein stability.

VI. Linkers

Monomer domains can be joined by a linker to form a multimer. For example, a linker can be positioned between each separate discrete monomer domain in a multimer.

Joining the selected monomer domains via a linker can be accomplished using a variety of techniques known in the art. For example, combinatorial assembly of polynucleotides encoding selected monomer domains can be achieved by restriction digestion and re-ligation, by PCR-based, self-priming overlap reactions, or other recombinant methods. The linker can be attached to a monomer before the monomer is identified for its ability to bind to a target multimer or after the monomer has been selected for the ability to bind to a target multimer.

The linker can be naturally-occurring, synthetic or a combination of both. For example, the synthetic linker can be a randomized linker, e.g., both in sequence and size. In one aspect, the randomized linker can comprise a fully randomized sequence, or optionally, the randomized linker can be based on natural linker sequences. The linker can comprise, e.g., a non-polypeptide moiety, a polynucleotide, a polypeptide or the like. See FIG. 9, which provides examples of linkers based on naturally occurring diversity in A-domain linkers taken from the human genome that can form a component of the binding proteins provided herein.

A linker can be rigid, or flexible, or a combination of both. Linker flexibility can be a function of the composition of both the linker and the monomer domains that the linker interacts with. The linker joins two selected monomer domain, and maintains the monomer domains as separate discrete monomer domains. The linker can allow the separate discrete monomer domains to cooperate yet maintain separate properties such as multiple separate binding sites for the same ligand in a multimer, or e.g., multiple separate binding sites for different ligands in a multimer. The linker may itself interact with the ligand or ligands, providing a binding site in addition to those binding sites provided by the constituent monomers of the multimer.

Choosing a suitable linker for a specific case where two or more monomer domains are to be connected can depend on a variety of parameters including, e.g., the nature of the monomer domains, the structure and nature of the target to which the polypeptide multimer should bind and/or the stability of the peptide linker towards proteolysis and oxidation.

The present disclosure provides methods for optimizing the choice of linker once the desired monomer domains/variants have been identified. Generally, libraries of multimers having a composition that is fixed with regard to monomer domain composition, but variable in linker composition and length, can be readily prepared and screened as described above.

Additional discussion of linkers can be found in U.S. Patent Publication No. 2005/0048512, for example, which is incorporated herein by reference.

VII. Identifying Monomers or Multimers with Affinity for a Target Molecule

Those of skill in the art can readily identify monomer domains with a desired property (e.g., binding affinity). In this regard, any method resulting in selection of domains with a desired property (e.g., a specific binding property) can be used. For example, the methods can comprise providing a plurality of different nucleic acids, each nucleic acid encoding a monomer domain; translating the plurality of different nucleic acids, thereby providing a plurality of different monomer domains; screening the plurality of different monomer domains for binding of the desired ligand or a mixture of ligands; and, identifying members of the plurality of different monomer domains that bind the desired ligand or mixture of ligands.

In addition, any method of mutagenesis, such as site-directed mutagenesis and random mutagenesis (e.g., chemical mutagenesis) can be used to produce monomer domains, e.g., for a monomer domain library. In some embodiments, error-prone PCR can be employed to create variants. Additional methods include aligning a plurality of naturally occurring monomer domains by aligning conserved amino acids in the plurality of naturally occurring monomer domains; and, designing the recombinant monomer domain by maintaining the conserved amino acids and inserting, deleting or altering amino acids around the conserved amino acids to generate the recombinant monomer domain. In one embodiment, the conserved amino acids comprise cysteines. In another embodiment, the inserting step uses random amino acids, or optionally, the inserting step uses portions of the naturally occurring monomer domains. The portions can ideally encode loops from domains from the same family. Amino acids are inserted or exchanged using synthetic oligonucleotides, or by shuffling, or by restriction enzyme based recombination. Human chimeric domains of the present disclosure can be employed in therapeutic applications where minimal immunogenicity is desired. The present disclosure provides methods for generating libraries of human chimeric domains. Human chimeric monomer domain libraries can be constructed by combining loop sequences from different variants of a human monomer domain, as described above. The loop sequences that are combined can be sequence-defined loops, structure-defined loops, B-factor-defined loops, or a combination of any two or more thereof.

Alternatively, a human chimeric domain library can be generated by modifying naturally-occurring human monomer domains at the amino acid level, as compared to the loop level. In some embodiments, to minimize the potential for immunogenicity, only those residues that naturally occur in protein sequences from the same family of human monomer domains are utilized to create the chimeric sequences. This can be achieved by providing a sequence alignment of at least two human monomer domains from the same family of monomer domains, identifying amino acid residues in corresponding positions in the human monomer domain sequences that differ between the human monomer domains, generating two or more human chimeric monomer domains, wherein each human chimeric monomer domain sequence consists of amino acid residues that correspond in type and position to residues from two or more human monomer domains from the same family of monomer domains. Libraries of human chimeric monomer domains can be employed to identify human chimeric monomer domains that bind to a target of interest by screening the library of human chimeric monomer domains for binding to a target molecule, and identifying a human chimeric monomer domain that binds to the target molecule. Suitable naturally-occurring human monomer domain sequences employed in the initial sequence alignment step include those corresponding to any of the naturally-occurring monomer domains described herein.

Domains of human monomer variant libraries of the present disclosure (whether generated by varying loops or single amino acid residues) can be prepared by methods known to those having ordinary skill in the art. Methods particularly suitable for generating these libraries are split-pool format and trinucleotide synthesis format as described in WO01/23401, incorporated herein by reference.

In some embodiments, monomer domains of the disclosure are screened for potential immunogenicity by:
(a) providing a candidate protein sequence;
(b) comparing the candidate protein sequence to a database of human protein sequences;
(c) identifying portions of the candidate protein sequence that correspond to portions of human protein sequences from the database; and
(d) determining the extent of correspondence between the candidate protein sequence and the human protein sequences from the database.

In general, the greater the extent of correspondence between the candidate protein sequence and one or more of the human protein sequences from the database, the lower the potential for immunogenicity is predicted as compared to a candidate protein having little correspondence with any of the human protein sequences from the database. A database of human protein sequences that is suitable for use in the practice of the invention method for screening candidate proteins can be found at the website for the National Center for Biotechnology Information (NCBI). This website provides the Basic Local Alignment Search Tool (BLAST) algorithm as a resource that can be used to find regions of local similarity between sequences. The program compares nucleotide or protein sequences to sequence databases and calculates the statistical significance of matches. Databases available for comparison contain sequence information from whole genomes of many vertebrate, invertebrate, plant, fungi, protozoan, prokaryotic and archaean species. BLAST can be used to infer functional and evolutionary relationships between sequences as well as help identify members of gene families. A second tool available at NCBI, COBALT (constraint-based alignment tool) allows the simultaneous alignment of multiple sequences that can be applied to database searches. These methods are particularly useful in determining whether a crossover sequence in a chimeric protein, such as, for example, a chimeric monomer domain, is likely to cause an immunogenic event. If the crossover sequence corresponds to a portion of a sequence found in the database of human protein sequences, it is possible that the crossover sequence is less likely to cause an immunogenic event.

Information pertaining to portions of human protein sequences from the database can be used to design a protein library of human-like chimeric proteins. Such library can be generated by using information pertaining to "crossover sequences" that exist in naturally occurring human proteins. As used herein the term "crossover sequence" refers to a sequence that is found in its entirety in at least one naturally occurring human protein, in which portions of the sequence are found in two or more naturally occurring proteins. Thus, recombination of the latter two or more naturally occurring proteins would generate a chimeric protein in which the chimeric portion of the sequence actually corresponds to a sequence found in another naturally occurring protein. The crossover sequence contains a chimeric junction of two consecutive amino acid residue positions in which the first amino acid position is occupied by an amino acid residue identical in type and position found in a first and second naturally occurring human protein sequence, but not a third naturally occurring human protein sequence. The second amino acid position is occupied by an amino acid residue identical in type and position found in a second and third naturally occurring human protein sequence, but not the first naturally occurring human protein sequence. In other words, the "second" naturally occurring human protein sequence corresponds to the naturally occurring human protein in which the crossover sequence appears in its entirety, as described above.

In some embodiments, a library of human-like chimeric proteins is generated by:

(a) identifying human protein sequences from a database that correspond to proteins from the same family of proteins; aligning the human protein sequences from the same family of proteins to a reference protein sequence;

(b) identifying a set of subsequences derived from different human protein sequences of the same family, wherein each subsequence shares a region of identity with at least one other subsequence derived from a different naturally occurring human protein sequence; and (c) identifying a chimeric junction from a first, a second, and a third subsequence, wherein each subsequence is derived from a different naturally occurring human protein sequence, and wherein the chimeric junction comprises two consecutive amino acid residue positions in which the first amino acid position is occupied by an amino acid residue common to the first and second naturally occurring human protein sequence, but not the third naturally occurring human protein sequence, and the second amino acid position is occupied by an amino acid residue common to the second and third naturally occurring human protein sequence, and generating human-like chimeric protein molecules each corresponding in sequence to two or more subsequences from the set of subsequences, and each comprising one of more of the identified chimeric junctions.

Thus, for example, if the first naturally-occurring human protein sequence is, A-B-C, and the second is, B-C-D-E, and the third is, D-E-F, then the chimeric junction is C-D. Alternatively, if the first naturally-occurring human protein sequence is D-E-F-G, and the second is B-C-D-E-F, and the third is A-B-C-D, then the chimeric junction is D-E. Human-like chimeric protein molecules can be generated in a variety of ways. For example, oligonucleotides comprising sequences encoding the chimeric junctions can be recombined with oligonucleotides corresponding in sequence to two or more subsequences from the above-described set of subsequences to generate a human-like chimeric protein, and libraries thereof. The reference sequence used to align the naturally occurring human proteins is a sequence from the same family of naturally occurring human proteins, or a chimera or other variant of proteins in the family.

Nucleic acids encoding fragments of naturally-occurring monomer domains can also be mixed and/or recombined (e.g., by using chemically or enzymatically-produced fragments) to generate full-length, modified monomer domains. The fragments and the monomer domain can also be recombined by manipulating nucleic acids encoding domains or fragments thereof. For example, ligating a nucleic acid construct encoding fragments of the monomer domain can be used to generate an altered monomer domain.

Altered monomer domains can also be generated by providing a collection of synthetic oligonucleotides (e.g., overlapping oligonucleotides) encoding conserved, random, pseudorandom, or a defined sequence of peptide sequences that are then inserted by ligation into a predetermined site in a polynucleotide encoding a monomer domain. Similarly, the sequence diversity of one or more monomer domains can be expanded by mutating the monomer domain(s) with site-directed mutagenesis, random mutation, pseudorandom mutation, defined kernal mutation, codon-based mutation, and the like. The resultant nucleic acid molecules can be propagated in a host for cloning and amplification. In some embodiments, the nucleic acids are shuffled.

The present disclosure also provides a method for recombining a plurality of nucleic acids encoding monomer domains and screening the resulting library for monomer domains that bind to the desired ligand or mixture of ligands or the like. Selected monomer domain nucleic acids can also be back-crossed by shuffling with polynucleotide sequences encoding neutral sequences (i.e., sequences having an insubstantial functional effect on binding), such as for example, by back-crossing with a wild-type or naturally-occurring sequence substantially identical to a selected sequence to produce native-like functional monomer domains. Generally, during back-crossing, subsequent selection is applied to retain the property, e.g., binding to the ligand.

In some embodiments, a monomer library is prepared by shuffling. In such a case, monomer domains are isolated and shuffled to combinatorially recombine the nucleic acid sequences that encode the monomer domains (recombination can occur between or within monomer domains, or both). The first step involves identifying a monomer domain having the desired property, e.g., affinity for a certain ligand. While maintaining the conserved amino acids during the recombination, the nucleic acid sequences encoding the monomer domains can be recombined, or recombined and joined into multimers.

An advantage of the methods and compositions disclosed herein is that known ligands, or unknown ligands can be used to select the monomer domains and/or multimers. No prior information regarding ligand structure is required to isolate the monomer domains of interest or the multimers of interest. The monomer domains and/or multimers identified can have biological activity, which is meant to include at least specific binding affinity for a selected or desired ligand, and, in some instances, will further include the ability to block the binding of other compounds, to stimulate or inhibit metabolic pathways, to act as a signal or messenger, to stimulate or inhibit cellular activity, and the like. Monomer domains can also be generated to function as ligands for receptors where the natural ligand for the receptor has not yet been identified (orphan receptors). These orphan ligands can be created to either block or activate the receptor to which they bind.

A single ligand can be used, or optionally a variety of ligands can be used to select the monomer domains and/or multimers. A monomer domain of the present disclosure can bind a single ligand or a variety of ligands. A multimer of the present disclosure can have multiple discrete binding sites for a single ligand, or optionally, can have multiple binding sites for a variety of ligands.

In some embodiments, multimers or monomers are screened for the ability to bind to a protein from multiple (e.g., 2, 3, or more) different species. For example, human and primate orthologous proteins can be screened, thereby generating polypeptides that bind the proteins (e.g., IgG, HSA or other serum half-life extender or other protein) from both a human and a primate, thereby allowing for ease of analysis of toxicology in primates for use in humans.

Also described are compositions that are produced by methods disclosed herein. For example, the present disclosure includes monomer domains selected or identified from a library and/or libraries comprising monomer domains produced by the methods disclosed herein.

The present disclosure also provides libraries of monomer domains and libraries of nucleic acids that encode monomer domains. The libraries can comprise, e.g., about 100, 250, 500 or more nucleic acids encoding monomer domains, or the library can include, e.g., about 100, 250, 500 or more polypeptides that encode monomer domains. Libraries can include monomer domains containing the same cysteine frame, e.g., A-domains or EGF-like domains.

In some embodiments, variants are generated by recombining two or more different sequences from the same family of monomer domains (e.g., the LDL receptor class A domain). Alternatively, two or more different monomer domains from different families can be combined to form a multimer. In some embodiments, the multimers are formed from monomers or monomer variants of at least one of the following family classes: an EGF-like domain, a Kringle-domain, a fibronectin type I domain, a fibronectin type II domain, a fibronectin type III domain, a PAN domain, a Gla domain, a SRCR domain, a Kunitz/Bovine pancreatic trypsin Inhibitor domain, a Kazal-type serine protease inhibitor domain, a Trefoil (P-type) domain, a von Willebrand factor type C domain, an Anaphylatoxin-like domain, a CUB domain, a thyroglobulin type I repeat, LDL-receptor class A domain, a Sushi domain, a Link domain, a Thrombospondin type I domain, an Immunoglobulin-like domain, a C-type lectin domain, a MAM domain, a von Willebrand factor type A domain, a Somatomedin B domain, a WAP-type four disulfide core domain, a F5/8 type C domain, a Hemopexin domain, an SH2 domain, an SH3 domain, a Laminin-type EGF-like domain, a C2 domain and derivatives thereof. In another embodiment, the monomer domain and the different monomer domain can include one or more domains found in the Pfam database and/or the SMART database. Libraries produced by the methods above, one or more cell(s) comprising one or more members of the library, and one or more displays comprising one or more members of the library also form aspect of the present disclosure.

Optionally, a data set of nucleic acid character strings encoding monomer domains can be generated e.g., by mixing a first character string encoding a monomer domain, with one or more character string encoding a different monomer domain, thereby producing a data set of nucleic acids character strings encoding monomer domains, including those described herein. In another embodiment, the monomer domain and the different monomer domain can include one or more domains found in the Pfam database and/or the SMART database. The methods can further comprise inserting the first character string encoding the monomer domain and the one or more second character string encoding the different monomer domain in a computer and generating a multimer character string(s) or library(s), thereof in the computer.

The libraries can be screened for a desired property such as binding of a desired ligand or mixture of ligands. For example, members of the library of monomer domains can be displayed and prescreened for binding to a known or unknown ligand or a mixture of ligands. The monomer domain sequences can then be mutagenized (e.g., recombined, chemically altered, etc.) or otherwise altered and the new monomer domains can be screened again for binding to the ligand or the mixture of ligands with an improved affinity. The selected monomer domains can be combined or joined to form multimers, which can then be screened for an improved affinity or avidity or altered specificity for the ligand or the mixture of ligands. Altered specificity can mean that the specificity is broadened, e.g., binding of multiple related viruses, or optionally, altered specificity can mean that the specificity is narrowed, e.g., binding within a specific region of a ligand. Those of skill in the art will recognize that there are a number of methods available to calculate avidity. See, e.g., Mammen et al., *Angew Chem Int. Ed.* 37:2754-2794 (1998); Muller et al., *Anal. Biochem.* 261:149-158 (1998).

VIII. Selection of Monomer Domains that Bind FGFR1c or β-Klotho

Preliminary screens can be conducted by screening for agents capable of binding to FGFR1c or β-Klotho. The binding assays can involve contacting an FGFR1c or β-Klotho protein (or a fragment thereof) with one or more test agents (i.e., monomers or multimers disclosed herein) and allowing sufficient time for the protein and test agents to form a binding complex. Any formed binding complexes can be detected using any of a number of established analytical techniques. Protein binding assays include, but are not limited to, enzyme-linked immunosorbent assays (ELISA), Alphascreen (amplified luminescent proximity homogeneous assay), immunohistochemical binding assays, flow cytometry or other assays. The FGFR1c and β-Klotho proteins utilized in such assays can be naturally expressed, cloned or synthesized. Similar methods can be used to identify monomer domains or multimers that bind IgG or HSA.

The screening methods disclosed herein can be performed as in vitro or cell-based assays. Cell-based assays can be performed in any cells in which FGFR1c, β-Klotho or both FGFR1c and β-Klotho is expressed. Cell-based assays can involve whole cells or cell fractions containing FGFR1c and/or β-Klotho to screen for agent binding or modulation of activity by the agent. Exemplary cell types that can be used according to the methods disclosed herein include, e.g., any mammalian cells, as well as fungal cells, including yeast, and bacterial cells. Cells can be primary cells or tumor cells or other types of immortal cell lines. Of course, FGFR1c or β-Klotho can be recombinantly expressed in cells that do not endogenously contain FGFR1c or β-Klotho.

FGFR1c or β-Klotho activity assays can also be used to identify a modulator (antagonist or agonist) of FGFR1c or β-Klotho. Additionally, activity assays to identify modulators of FGF21-mediated activity, such as those described in the Examples, can also be employed. In these embodiments, one or more test agents are contacted to a cell expressing FGFR1c, or both FGFR1c and β-Klotho, and then tested for FGFR1c-, or FGF21-mediated activity, respectively. In order to determine that the modulator has β-Klotho dependent activity (a characteristic of FGF-21) it is necessary to show that it can induce agonist activity on cells co-expressing a member of the FGFR family (FGFR1c, FGFR2c, FGFR3c, and FGFR4) and β-Klotho (see, e.g., FIG. 37). Exemplary FGFR1c-mediated activities include activation of luciferase expression under the control of an ERK pathway sensitive promoter in response to FGF-1 in the absence of β-Klotho (see, e.g., FIG. 46) and exemplary FGF21-mediated activities include activation of luciferase expression under the control of an ERK pathway sensitive promoter in response to FGF-21 in the presence of β-Klotho (see, e.g., FIGS. 30A-30B and 31A-31B, 33 to 35, 38A-38B, 45, and 47A-47B to through 49A-49B). In other embodiments, downstream molecular events can also be monitored to determine signaling activity. For example, FGF21-mediated signal transduction is mediated by the ERK pathway and various methods are known to measure signaling through the ERK pathway, including those disclosed herein, e.g., in Examples 9, 10 and 11.

In some embodiments, activity assays, such as those disclosed herein in Example 9, can also used to confirm that identified agonist monomers or multimers (e.g., those that bind to both FGFR1c or β-Klotho) lack antagonist activity (i.e., that they do not block FGF21-mediated signaling).

Agents that are initially identified by any of the foregoing screening methods can be further tested to validate the apparent activity. Such studies can be conducted with suitable animal models. The basic format of such methods involves administering an agent of interest identified during an initial screen to an animal that serves as a model for humans and then determining if FGF21-mediated signaling is in fact modulated and/or a desired physiological effect is observed (e.g., lowering of blood glucose levels, blood insulin levels or blood lipid levels) and/or a disease or condition is ameliorated (e.g., diabetes or obesity). The animal models utilized in validation studies generally are mammals of any kind. Specific examples of suitable animals include, but are not limited to, non-human primates (including cynomolgous and rhesus monkeys), mice and rats.

Selection of monomer domains that bind FGFR1c or β-Klotho from a library of domains can be accomplished using any of a variety of procedures. For example, one method of identifying monomer domains which have a desired property (e.g., binding FGFR1c or β-Klotho or IgG) involves translating a plurality of nucleic acids, where each nucleic acid encodes a monomer domain, screening the polypeptides encoded by the plurality of nucleic acids, and identifying those monomer domains that, e.g., bind to a desired ligand or mixture of ligands, thereby producing a selected monomer domain. The monomer domains expressed by each of the nucleic acids can be tested for their ability to bind to the ligand by methods known in the art (e.g., panning, affinity chromatography, ELISA, Alphascreen, or FACS analysis, as are described herein).

As noted herein, the selection of monomer domains can be based on binding to a ligand such as FGFR1c or β-Klotho, or a fragment thereof or other target molecule (e.g., lipid, carbohydrate, nucleic acid and the like). The ligand can be provided either as a recombinant purified protein, or expressed on the surface of a cell, such as a bacterial, fungal, insect or mammalian cell. Other molecules can optionally be included in the methods along with the target, e.g., ions such as $Ca^{+2}$.

When a monomer domain is selected based on its ability to bind to a ligand, the selection basis can include selection based on a slow dissociation rate, which is usually predictive of high affinity. The valency of the ligand can also be varied to control the average binding affinity of selected monomer domains. The ligand can be bound to a surface or substrate at varying densities, such as by including a competitor compound, by dilution, or by other method known to those in the art. High density (valency) of predetermined ligand can be used to enrich for monomer domains that have relatively low affinity, whereas a low density (valency) can preferentially enrich for higher affinity monomer domains.

A variety of reporting display vectors or systems can be used to express nucleic acids encoding the monomer domains and/or multimers disclosed herein and to test for a desired activity. For example, a phage display system is a system in which monomer domains are expressed as fusion proteins on the phage surface (Pharmacia, Milwaukee Wis.). Phage display can involve the presentation of a polypeptide sequence encoding monomer domains on the surface of a filamentous bacteriophage, typically as a fusion with a bacteriophage coat protein.

Generally in these methods, each phage particle or cell serves as an individual library member displaying a single species of displayed polypeptide in addition to the natural phage or cell protein sequences. The nucleic acids are cloned into the phage DNA at a site which results in the transcription of a fusion protein, a portion of which is encoded by the plurality of the nucleic acids. The phage containing a nucleic acid molecule undergoes replication and transcription in the cell. The leader sequence of the fusion protein directs the transport of the fusion protein to the tip of the phage particle. Thus, the fusion protein that is partially encoded by the nucleic acid is displayed on the phage particle for detection and selection by the methods described above and below. For example, the phage library can be incubated with a predetermined ligand such as FGFR1c or β-Klotho or a fragment thereof, so that phage particles which present a fusion protein sequence that binds to the ligand can be differentially partitioned from those that do not present polypeptide sequences that bind to the predetermined ligand. For example, the separation can be provided by immobilizing the predetermined ligand. The phage particles (i.e., library members) which are bound to the immobilized ligand are then recovered and replicated to amplify the selected phage subpopulation for a subsequent round of affinity enrichment and phage replication. After several rounds of affinity enrichment and phage replication, the phage library members that are thus selected are isolated and the nucleotide sequence encoding the displayed polypeptide sequence is determined, thereby identifying the sequence(s) of polypeptides that bind to the predetermined ligand. Such methods are further described in PCT Publication Nos. WO 91/17271, WO 91/18980, WO 91/19818 and WO 93/08278.

Examples of other display systems include ribosome displays, a nucleotide-linked display (see, e.g., U.S. Pat. Nos. 6,281,344; 6,194,550, 6,207,446, 6,214,553, and 6,258,558), polysome display, cell surface displays and the like. The cell surface displays include a variety of cells, e.g., *E. coli*, yeast and/or mammalian cells. When a cell is used as a display, the nucleic acids, e.g., those obtained by PCR amplification followed by digestion, are introduced into the cell and translated. Optionally, polypeptides encoding the monomer domains or the multimers disclosed herein can be introduced, e.g., by injection, into the cell.

The monomer and multimer libraries of the present disclosure can be screened for a desired property such as binding of a desired ligand (e.g., FGFR1c or β-Klotho) or a mixture of ligands. For example, members of the library of monomer domains can be displayed and prescreened for binding to a known or unknown ligand or a mixture of ligands. The monomer domain sequences can then be mutagenized (e.g., recombined, chemically altered, etc.) or otherwise altered and the new monomer domains can be screened again for binding to the ligand or the mixture of ligands with an improved affinity. The selected monomer domains can be combined or joined to form multimers, which can then be screened for an improved affinity or avidity or altered specificity for the ligand or the mixture of ligands. Altered specificity can mean that the specificity is broadened, e.g., binding of multiple related ligands, or optionally, altered specificity can mean that the specificity is narrowed, e.g., binding within a specific region of a ligand. Those of skill in the art will recognize that there are a number of methods available to calculate avidity. See, e.g., Mammen et al., *Angew Chem Int. Ed.* 37:2754-2794 (1998); Muller et al., *Anal. Biochem.* 261:149-158 (1998).

Those of skill in the art will recognize that the steps of generating variation and screening for a desired property can be repeated (i.e., performed recursively) to optimize results. For example, in a phage display library or other like format, a first screening of a library can be performed at relatively lower stringency, thereby selected as many particles associated with a target molecule as possible. The selected particles can then be isolated and the polynucleotides encoding the monomer or multimer can be isolated from the particles.

Additional variations can then be generated from these sequences and subsequently screened at higher affinity.

All the compositions of the present disclosure, e.g., monomer domains as well as multimers and libraries thereof, can be optionally bound to a matrix of an affinity material. Examples of affinity material include beads, a column, a solid support, a microarray, other pools of reagent-supports, and the like.

When multimers capable of binding relatively large targets are desired, they can be generated by a "walking" selection method, as was performed to generate a number of the disclosed binding proteins. This method is carried out by providing a library of monomer domains and screening the library of monomer domains for affinity to a first target molecule. Once at least one monomer that binds to the target is identified, that monomer is covalently linked to a new library or each remaining member of the original library of monomer domains. This new library of multimers (dimers) is then screened for multimers that bind to the target with an increased affinity, and a multimer that binds to the target with an increased affinity can be identified. The "walking" monomer selection method provides a way to assemble a multimer that is composed of monomers that can act additively or even synergistically with each other given the restraints of linker length. This walking technique is very useful when selecting for and assembling multimers that are able to bind large target proteins with high affinity. The walking method can be repeated to add more monomers thereby resulting in a multimer comprising 2, 3, 4, 5, 6, 7, 8 or more monomers linked together. This "walking" method was employed in the generation of β-Klotho-specific binding proteins, as described in Example 7.

Figure 7:
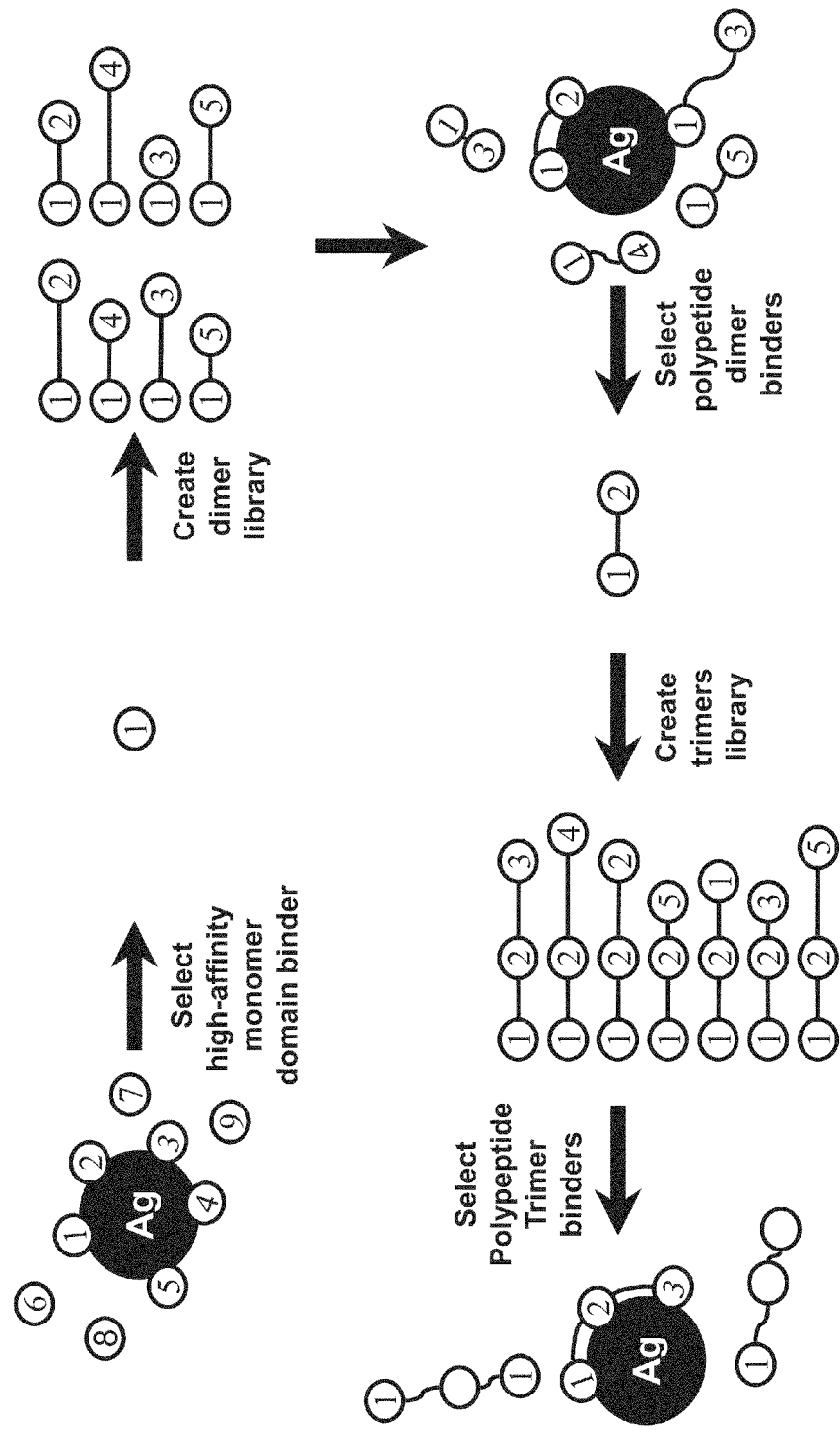
FIG. 7 is a cartoon schematically illustrating a guided selection strategy. A monomer domain with appropriate binding properties is identified from a library of monomer domains. The identified monomer domain is then linked to monomer domains from a naïve library of monomer domains to form a library of multimers. The multimer library is screened to identify a pair of monomer domains that bind simultaneously to the target. This process can then be repeated until the optimal binding properties are obtained in the multimer.

In some embodiments, the selected multimer comprises more than two domains. Such multimers can be generated in a step fashion, e.g., where the addition of each new domain is tested individually and the effect of the domains is tested in a sequential fashion. See FIG. 7. In an alternate embodiment, domains are linked to form multimers comprising more than two domains and selected for binding without prior knowledge of how smaller multimers, or alternatively, how each domain, bind.

The methods of the present disclosure also include methods of evolving monomers or multimers. Intra-domain recombination can be introduced into monomers across the entire monomer or by taking portions of different monomers to form new recombined units. Interdomain recombination (e.g., recombining different monomers into or between multimers) or recombination of modules (e.g., multiple monomers within a multimer) can be achieved. Inter-library recombination is also contemplated.

Methods for evolving monomers or multimers can comprise, e.g., any or all of the following steps: providing a plurality of different nucleic acids, where each nucleic acid encoding a monomer domain; translating the plurality of different nucleic acids, which provides a plurality of different monomer domains; screening the plurality of different monomer domains for binding of the desired ligand (e.g., FGFR1c or β-Klotho) or mixture of ligands; identifying members of the plurality of different monomer domains that bind the desired ligand or mixture of ligands, which provides selected monomer domains; joining the selected monomer domains with at least one linker to generate at least one multimer, wherein the at least one multimer comprises at least two of the selected monomer domains and the at least one linker; and, screening the at least one multimer for an improved affinity or avidity or altered specificity for the desired ligand or mixture of ligands as compared to the selected monomer domains.

Variation can be introduced into either monomers or multimers. An example of improving monomers includes intra-domain recombination in which two or more (e.g., three, four, five, or more) portions of the monomer are amplified separately under conditions to introduce variation (for example by shuffling or other recombination method) in the resulting amplification products, thereby synthesizing a library of variants for different portions of the monomer. By locating the 5' ends of the middle primers in a "middle" or "overlap" sequence that both of the PCR fragments have in common, the resulting "left" side and "right" side libraries can be combined by overlap PCR to generate novel variants of the original pool of monomers. These new variants can then be screened for desired properties, e.g., panned against a target or screened for a functional effect. The "middle" primer(s) can be selected to correspond to any segment of the monomer, and will typically be based on the scaffold or one or more consensus amino acids within the monomer (e.g., cysteines such as those found in A domains).

Similarly, multimers can be created by introducing variation at the monomer level and then recombining monomer variant libraries. On a larger scale, multimers (single or pools) with desired properties can be recombined to form longer multimers. In some cases variation is introduced (typically synthetically) into the monomers or into the linkers to form libraries. This can be achieved, e.g., with two different multimers that bind to two different targets, thereby eventually selecting a multimer with a portion that binds to one target and a portion that binds a second target.

Additional variation can be introduced by inserting linkers of different length and composition between domains. This allows for the selection of optimal linkers between domains. In some embodiments, optimal length and composition of linkers will allow for optimal binding of domains. In some embodiments, the domains with a particular binding affinity(s) are linked via different linkers and optimal linkers are selected in a binding assay. For example, domains are selected for desired binding properties and then formed into a library comprising a variety of linkers. The library can then be screened to identify optimal linkers. Alternatively, multimer libraries can be formed where the effect of domain or linker on target molecule binding is not known.

Methods of the present disclosure also include generating one or more selected multimers by providing a plurality of monomer domains. The plurality of monomer domains is screened for binding of a desired ligand or mixture of ligands. Members of the plurality of domains that bind the desired ligand or mixture of ligands are identified, thereby providing domains with a desired affinity. The identified domains are joined with at least one linker to generate the multimers, wherein each multimer comprises at least two of the selected domains and the at least one linker; and, the multimers are screened for an improved affinity or avidity or altered specificity for the desired ligand or mixture of ligands as compared to the selected domains, thereby identifying the one or more selected multimers.

Multimer libraries can be generated, in some embodiments, by combining two or more libraries or monomers or multimers in a recombinase-based approach, where each library member comprises as recombination site (e.g., a lox site). A larger pool of molecularly diverse library members in principle harbor more variants with desired properties, such as higher target-binding affinities and functional activities. When libraries are constructed in phage vectors, which can be transformed into *E. coli*, library size (typically $10^9$-$10^{10}$ members) is limited by the transformation efficiency of *E. coli*. A recombinase/recombination site system (e.g., the CreloxP system) and in vivo recombination can be exploited to generate libraries that are not limited in size by the transformation efficiency of E. coli.

For example, the Cre-loxP system can be used to generate dimer libraries with $10^{10}$, $10^{11}$, $10^{12}$, $10^{13}$ members, or even greater diversity. In some embodiments, E. coli as a host for one naïve monomer library and a filamentous phage that carries a second naïve monomer library are used. The library size in this case is limited only by the number of infective phage (carrying one library) and the number of infectible E. coli cells (carrying the other library). For example, infecting $10^{12}$ E. coli cells (1 L at OD600=1) with >$10^{12}$ phage could produce as many as $10^{12}$ dimer combinations.

Selection of multimers can be accomplished using a variety of techniques including those mentioned above for identifying monomer domains. Other selection methods include, e.g., a selection based on an improved affinity or avidity or altered specificity for the ligand compared to selected monomer domains. For example, a selection can be based on selective binding to specific cell types, or to a set of related cells or protein types (e.g., different virus serotypes). Optimization of the property selected for, e.g., avidity of a ligand, can then be achieved by recombining the domains, as well as manipulating amino acid sequence of the individual monomer domains or the linker domain or the nucleotide sequence encoding such domains, as mentioned in the present disclosure.

One method for identifying multimers can be accomplished by displaying the multimers. As with the monomer domains, the multimers are optionally expressed or displayed on a variety of display systems, e.g., phage display, ribosome display, polysome display, nucleotide-linked display (see, e.g., U.S. Pat. Nos. 6,281,344; 6,194,550, 6,207,446, 6,214,553, and 6,258,558) and/or cell surface display, as described above. Cell surface displays can include but are not limited to E. coli, yeast or mammalian cells. In addition, display libraries of multimers with multiple binding sites can be panned for avidity or affinity or altered specificity for a ligand or for multiple ligands.

Monomers or multimers can be screened for target binding activity in yeast cells using a two-hybrid screening assay. In this type of screen the monomer or multimer library to be screened is cloned into a vector that directs the formation of a fusion protein between each monomer or multimer of the library and a yeast transcriptional activator fragment (i.e., Ga14). Sequences encoding the "target" protein are cloned into a vector that results in the production of a fusion protein between the target and the remainder of the Ga14 protein (the DNA binding domain). A third plasmid contains a reporter gene downstream of the DNA sequence of the Ga14 binding site. A monomer that can bind to the target protein brings with it the Ga14 activation domain, thus reconstituting a functional Ga14 protein. This functional Ga14 protein bound to the binding site upstream of the reporter gene results in the expression of the reporter gene and selection of the monomer or multimer as a target binding protein. (see Chien et. al. (1991) *Proc. Natl. Acad. Sci.* (USA) 88:9578; Fields S. and Song O. (1989) *Nature* 340: 245) Using a two-hybrid system for library screening is further described in U.S. Pat. No. 5,811,238 (see also Silver S. C. and Hunt S. W. (1993) *Mol. Biol. Rep.* 17:155; Durfee et al. (1993) *Genes Devel.* 7:555; Yang et al. (1992) *Science* 257:680; Luban et al. (1993) *Cell* 73:1067; Hardy et al. (1992) *Genes Devel.* 6:801; Bartel et al. (1993) *Biotechniques* 14:920; and Vojtek et al. (1993) *Cell* 74:205). Another useful screening system is the E. coli/BCCP interactive screening system (Germino et al. (1993) *Proc. Nat. Acad. Sci.* (U.S.A.) 90:993; Guarente L. (1993) *Proc. Nat. Acad. Sci.* (U.S.A.) 90:1639).

Other variations include the use of multiple binding compounds, such that monomer domains, multimers or libraries of these molecules can be simultaneously screened for a multiplicity of ligands or compounds that have different binding specificity. Multiple predetermined ligands or compounds can be concomitantly screened in a single library, or sequential screening against a number of monomer domains or multimers. In one variation, multiple ligands or compounds, each encoded on a separate bead (or subset of beads), can be mixed and incubated with monomer domains, multimers or libraries of these molecules under suitable binding conditions. The collection of beads, comprising multiple ligands or compounds, can then be used to isolate, by affinity selection, selected monomer domains, selected multimers or library members. Generally, subsequent affinity screening rounds can include the same mixture of beads, subsets thereof, or beads containing only one or two individual ligands or compounds. This approach affords efficient screening, and is compatible with laboratory automation, batch processing, and high throughput screening methods.

In another embodiment, multimers can be simultaneously screened for the ability to bind multiple ligands, wherein each ligand comprises a different label. For example, each ligand can be labeled with a different fluorescent label, contacted simultaneously with a multimer or multimer library. Multimers with the desired affinity are then identified (e.g., by FACS sorting) based on the presence of the labels linked to the desired labels.

Libraries of either monomer domains or multimers (referred to in the following discussion for convenience as "affinity agents") can be screened (i.e., panned) simultaneously against multiple ligands in a number of different formats. For example, multiple ligands can be screened in a simple mixture, in an array, displayed on a cell or tissue (e.g., a cell or tissue provides numerous molecules that can be bound by the monomer domains or multimers disclosed herein), and/or immobilized. The libraries of affinity agents can optionally be displayed on yeast or phage display systems. Similarly, if desired, the ligands (e.g., encoded in a cDNA library) can be displayed in a yeast or phage display system.

Initially, the affinity agent library is panned against the multiple ligands. Optionally, the resulting "hits" are panned against the ligands one or more times to enrich the resulting population of affinity agents.

If desired, the identity of the individual affinity agents and/or ligands can be determined. In some embodiments, affinity agents are displayed on phage. Affinity agents identified as binding in the initial screen are divided into a first and second portion. The first portion is infected into bacteria, resulting in either plaques or bacterial colonies, depending on the type of phage used. The expressed phage are immobilized and then probed with ligands displayed in phage selected as described below.

The second portion are coupled to beads or otherwise immobilized and a phage display library containing at least some of the ligands in the original mixture is contacted to the immobilized second portion. Phage that bind to the second portion are subsequently eluted and contacted to the immobilized phage described in the paragraph above. Phage-phage interactions are detected (e.g., using a monoclonal antibody specific for the ligand-expressing phage) and the resulting phage polynucleotides can be isolated.

In some embodiments, the identity of an affinity agent-ligand pair is determined For example, when both the affinity agent and the ligand are displayed on a phage or yeast, the DNA from the pair can be isolated and sequenced. In some embodiments, polynucleotides specific for the ligand and affinity agent are amplified. Amplification primers for each reaction can include 5' sequences that are complementary such that the resulting amplification products are fused, thereby forming a hybrid polynucleotide comprising a polynucleotide encoding at least a portion of the affinity agent and at least a portion of the ligand. The resulting hybrid can be used to probe affinity agent or ligand (e.g., cDNA-encoded) polynucleotide libraries to identify both affinity agent and ligand.

The above-described methods can be readily combined with "walking" to simultaneously generate and identify multiple multimers, each of which bind to a ligand in a mixture of ligands. In these embodiments, a first library of affinity agents (monomer domains or multimers) are panned against multiple ligands and the eluted affinity agents are linked to the first or a second library of affinity agents to form a library of multimeric affinity agents (e.g., comprising 2, 3, 4, 5, 6, 7, 8, 9, or more monomers), which are subsequently panned against the multiple ligands. This method can be repeated to continue to generate larger multimeric affinity agents. Increasing the number of monomer domains may result in increased affinity and avidity for a particular target. Of course, at each stage, the panning is optionally repeated to enrich for significant binders. In some cases, walking will be facilitated by inserting recombination sites (e.g., lox sites) at the ends of monomers and recombining monomer libraries by a recombinase-mediated event.

The selected multimers of the above methods can be further manipulated, e.g., by recombining or shuffling the selected multimers (recombination can occur between or within multimers or both), mutating the selected multimers, and the like. This results in altered multimers which then can be screened and selected for members that have an enhanced property compared to the selected multimer, thereby producing selected altered multimers. In view of the description herein, it is clear that the following process can be followed. Recombinant or non-recombinant monomer domains can be recombined or variants can be formed. Optionally the domains initially or later are selected for those sequences that are less likely to be immunogenic in the host for which they are intended. Optionally, a phage library comprising the recombined domains is panned for a desired affinity. Monomer domains or multimers expressed by the phage can be screened for $IC_{50}$ for a target. Hetero- or homo-meric multimers can be selected. The selected polypeptides can be selected for their affinity to any target, including, e.g., hetero- or homo-multimeric targets.

Linkers, multimers or selected multimers produced by the methods described herein form aspects of the present disclosure. Libraries comprising multimers, e.g., a library comprising about 100, 250, 500 or more members, produced as described herein or selected by the methods disclosed herein are provided. In some embodiments, one or more cell comprising members of the libraries, are also included. Libraries of the recombinant polypeptides are also a feature of the present disclosure, e.g., a library comprising about 50, 100, 250, 500 or more different recombinant polypeptides.

Compositions comprising the polypeptides disclosed herein can be bound to a matrix of an affinity material, e.g., the recombinant polypeptides. Examples of affinity material include, e.g., beads, a column, a solid support, and/or the like.

IX. Therapeutic and Prophylactic Treatment Methods

In other aspects, the present disclosure also provides methods of therapeutically or prophylactically treating a disease or disorder by administering in vivo or ex vivo one or more nucleic acids or binding proteins described herein (or compositions comprising a pharmaceutically acceptable excipient and one or more such nucleic acids or polypeptides) to a subject, including, e.g., a mammal, including a human, primate, mouse, pig, cow, goat, rabbit, rat, guinea pig, hamster, horse, sheep; or a non-mammalian vertebrate such as a bird (e.g., a chicken or duck), fish, or invertebrate.

Binding proteins that bind FGFR1c, β-Klotho or both FGFR1c and β-Klotho, particularly those that activate FGF21-mediated signaling, including binding proteins comprising FGFR1c and/or β-Klotho-binding monomer domains or multimers, can be employed to treat of a number of human diseases. Exemplary binding domains include the specific sequences disclosed herein, including, but not limited to:

```
Family 1 Motif:
                                                           (SEQ ID NO: 74)
C[AGLQRV][ALPST][DGINRS][ELQ]F[PQT]C[GHKNQRS][DGNS][GST][EGKNRS]

[IRST-]C[ILV][PS][LPQRV][AHKPQRT]W[LRV]CDG[DEV][DNP]DC[EGR]D

[DGNS]SDE[AEKST][DGNPS][AD-][IH-]C;  (Naïve A1)

Family 2 Motif:
                                                           (SEQ ID NO: 108)
CG[AE][GS]LFTC[GR][NRS][AST][KN]ICIS[EHQS][AV]W[IV]CDG[IV]DDC[DE]DN SDE[DKMNT][NSY]C;  (M03/M15 mutants)

Family 3 Motif:
                                                           (SEQ ID NO: 119)
CG[APST][DN][LMQ]FTC[QR][RS]TN[IM]CIS[DKPQR][ATV]WVCDGVDDC[DE]D

[DENY]SDE[IQRT][AGTV]C  (M23 Mutants)

Family 4 Motif:
                                                           (SEQ ID NO: 130)
C[LAPRVKQGHS][APSHR][-T][DNGSHAF][EHQ]F[HPQTRW]C[GSQRNLHK]

[SND][GSTNY][RHQGHNSE][RIT-]C[ILV][HNPS][AGHLSQPREV]

[TPGSRAHN-][WL][ILRV]CD[GMW][GYDVEL][PWLDN]DC[GERQLK]D

[GNDSKWHY][PQSW]D[EPQY][APS-][LPQS-][AEHKLTV][HILSTDNGMVW]C;

(β-Klotho Naïve A1)
```

```
Family 5 Motif:
                                                   (SEQ ID NO: 1242)
C[HNP-][AP-][HIKLMPRV-][AEILY][ADEGQRY][ADEHIKLNPQS][DHLMSY]C

[AEKPQT][AEHKNQRS][FLRY][DFVY]GDG[DEGIKNRSV]C[DEGHNQRS][EKPQS]

[ADEGHPQ]C[DGNS][FLNST][AEPSY][AEGKRT]C[ADGILNSV]WDG[DFGLMV]

[DN]C (β-Klotho Naïve LNR/Notch)

Family 6 Motif:
                                                   (SEQ ID NO: 185)
C[LMP][PST][DH]EF[QR]C[GR]SG[RW]CIP[LQR][AKRST]W[GV]CDGLNDCGDGSG E[SW]PA[HLQ]C; β-Klotho M01 mutagenesis Family 7 Motif:
                                                   (SEQ ID NO: 194)
C[LRW][PST][GS][AEHQS]F[HQ]C[NS][NT]GHCLS[APQRS][ST]WVCDG[FY][DEVY]

DC[DEG]D[GW]SDE[ASV][KN]C; β-Klotho M25 mutagenesis

Family 8 Motif:
                                                   (SEQ ID NO: 207)
C[EQ][PS][DE]EF[MRT]C[RS]SGRCIP[QV][HIST]WLCDGLNDCGDGSDE[PR]P[AE]

[HQ]C; β-Klotho M42 mutagenesis

Family 9 Motif:
                                                   (SEQ ID NO: 212)
C[HNP][STW]F[HN][HKQ]F[EK]CRN[GR]QCIPL[HY]LVCDGVPDC[AG]D[DN]SDET

[ADY]C; β-Klotho M50 mutagenesis

Family 10 Motif:
                                                   (SEQ ID NO: 217)
C[ELPQR][APS][DGIN][EGQ][FQ][FKPQRT][-E]C[GNRS][NS]G[HNQR]C[IV]P

[AELPQRV][AHPQRT]W[LRV]CDG[DEV][DNP]DC[GLQ]D[DGNS]SDE[AEKT][DGL

NS][-A][-H]C;

(SEQ ID NO: 493)
C-terminal walk from β-Klotho M01

Family 11 Motif:
                                                   (SEQ ID NO: 232)
C[AGLP]PD[EQ]F[KR]C[GKNRS]SG[NQRS]C[IL]P[ELQ][DHNT]W[LRV]CDG[DLV]

[DN]DC[EGV]D[GS]SDE[AET][DGNP][-D][-L]C;

(SEQ ID NO: 493)
N-terminal walk from β-Klotho M01

Family 12 Motif:
                                                   (SEQ ID NO: 240)
CA[PS][DNS][EQ]F[QR]C[GH][DN][GNT][GHN][-IT]C[IL][LPS][ER][AGT][WL]C

DG[DEV][DN]DC[AEG]DGSDE[AE][DG]C;

(SEQ ID NO: 499)
N-terminal walk from β-Klotho M06

Family 13 Motif:
                                                   (SEQ ID NO: 245)
C[AP]P[DG][EQ]F[RT]C[KNR][NS]G[QR]C[IV]P[LQ][AHP]W[LV]CDG[DE][DN]DC

[GQ]DNSDE[EST][DNP][-A][-T]C;

(SEQ ID NO: 499)
C-terminal walk from β-Klotho M06

Family 14 Motif:
                                                   (SEQ ID NO: 249)
C[AGPR][AP][DGNS][EQ]F[QRT]C[GSK]N[GT][GHR][-R]

C[ILV][PS][ALQ][NST]W[LRV]CDG[DEV]DDC[GL]DGSDE[AET][DNS][-A][-T]C;

(SEQ ID NO: 694)
N-terminal walk from β-Klotho M08
```

```
Family 15 Motif:
                                                              (SEQ ID NO: 254)
C[AGP][APS][DGN][EQ]F[QRT]C[GNRS][GNS][GT][GKQS][-IK]C[ILV]P[LQRV]

[AEHP]W[LRV]CDG[DLV][DN]DCGD[GN]SDE[AEKPS][GLPS][-AEV][-IT]C;

(SEQ ID NO: 481)
N-terminal walk from β-Klotho M21

Family 16 Motif:
                                                              (SEQ ID NO: 394)
CQSNEFRCRSGRCIPQHWLCDGLNDCGDGSDE[PS][PQ][AQ][-H]C;

(SEQ ID NO: 481)
C-terminal walk from β-Klotho M21

Family 17 Motif:
                                                              (SEQ ID NO: 265)
C[APQR][ASP][DG][EQ]F[PQ]C[EKNR][NS][GT][GHN][-R]C[ILV][PS][ALPR][ANRT]

W[LRV]CDG[EV][DN]DC[AGR]D[GNS]SDE[AEKS][GLNS][-A][-H]C;

(SEQ ID NO: 305)
N-terminal walk from β-Klotho M42

Family 18 Motif:
                                                              (SEQ ID NO: 270)
CRP[DG]EF[QR]C[GKR][NS]G[HR]C[IV]P[GLQ][PT]W[RV]CDG[DE][DP]DCQD[GS]S

DE[AET][DGN]C;

(SEQ ID NO: 305)
C-terminal walk from β-Klotho M42

Family 19 Motif:
                                                              (SEQ ID NO: 274)
C[AGLR][APS][DGN][EQ]F[RQT]C[GHKNRS][NS][GSTY][DEGNR][-RT]C[ILV]P

[AGLPRV][AHNPT]W[LRV]CDG[DEV][DN]DC[AEGRV]D[DGN]SDE[AEST][ADGNS]

[-D]C;

(SEQ ID NO: 306)
N-terminal walk from β-Klotho M50

Family 20 Motif:
                                                              (SEQ ID NO: 284)
C[LQ][PS]G[EQ]FRC[KQ][NT][GT]R[-T]C[IL]P[LR][AK][LW][LV]CDGVDDC

[EL]DDSDE[AK]DC;

(SEQ ID NO: 306)
C-terminal walk from β-Klotho M50
```

Exemplary human diseases for which activation of FGF21-mediated signaling is ameliorative include, e.g., diabetes, obesity, dyslipidimia, hypertension, hepatosteaotosis, non-alcoholic steatohepatitis (NASH), acute pancreatitis, metabolic syndrome, cardiovascular disease, such as atherosclerosis, and aging.

In some aspects, a monomer or multimer disclosed herein is administered to a subject with at least one other molecule used for treatment of one of the above-listed ailments. The other molecule can be prepared in a formulation with the monomer or multimer or can be administered simultaneously or before or after the monomer or multimer is administered.

In another aspect, the present disclosure provides a method of treating a subject for diabetes with a therapeutic monomer or multimer of the present disclosure, such as the monomers and multimers described herein, together with one or more other treatments. In one embodiment, such a combination therapy achieves a synergistic effect. The monomers or multimers can be administered in combination with one or more of the type 2 diabetes treatments currently available. These treatments include biguanide (metformin), and sulfonylureas (such as glyburide, glipizide). Additional treatments directed at maintaining glucose homeostasis including PPAR gamma antagonists (pioglitazone, rosiglitazone); and alpha glucosidase inhibitors (acarbose, voglibose). Additional treatments include injectable treatments such as Exenatide® (glucagon-like peptide), and Symlin® (pramlintide).

In some embodiments, a binding protein comprising a monomer or multimer described herein that binds FGFR1c, β-Klotho or both FGFR1c and β-Klotho is used to decrease blood glucose levels and/or blood triglyceride levels and/or blood lipid levels and/or blood insulin levels in a subject. The subject can be one who has a genetic history (naturally-occurring or induced) of diabetes or obesity, or otherwise is at risk from ill health effects of high levels of glucose, high levels of triglycerides or high levels of lipids. FGF21 is a mediator of blood glucose and lipid levels. This is evidenced by the fact that FGF21 administration in mice reduces glycemia (Berglund et al 2009 *Endocrinology* 150: 4084-93), reverses hepatic steatosis, increases energy expenditure, and improves insulin sensitivity (Xu et al 2009 *Diabetes* 58: 250-9) and corrects obesity (Coskun et al 2008 *Endocrinology*

149: 6018-27). In diabetic rhesus monkeys chronic FGF21 administration has been shown to reduce fasting plasma glucose, fructosamine, triglycerides, insulin, and glucagon without causing hypoglycemia. Additionally improvements to serum lipid profiles plus a small but significant reduction in weight was observed (Kharitonenkov et al., (2007) *Endocrinology* 148: 774-81).

In some embodiments, a binding protein comprising a monomer or multimer described herein that binds FGFR1c, β-Klotho or both FGFR1c and β-Klotho is used to reduce inflammatory damage in acute pancreatitis. This is evidenced by the severe disease that follows experimental induction of pancreatitis with cerulein in FGF21 knockout mice. Transgenic mice constituitively expressing human FGF21 from a liver-specific promoter exhibited decreased inflammation in the pancreas following cerulein administration (Johnson et al., (2009) *Gasteroenterology* 137(5):1795-1804).

In some embodiments, a binding protein comprising a monomer or multimer disclosed herein that binds FGFR1c, β-Klotho or both FGFR1c and β-Klotho is administered in combination with a drug that reduces blood glucose and/or blood lipid levels. Statins, resins (cholestyramine, colestipol, colesevalam) and nicotinic acid are examples of drugs that reduce lipid levels. Exemplary statins include, but are not limited to, atorvastatin, fluvastatin, lovastatin, pravastatin, rosuvastatin, and simvastatin. Examples of compounds that lower blood glucose levels include insulin and rosiglitizone.

In one aspect of the disclosure, in ex vivo methods, one or more cells or a population of cells of interest of a subject (e.g., tumor cells, tumor tissue sample, organ cells, blood cells, cells of the skin, lung, heart, muscle, brain, mucosae, liver, intestine, spleen, stomach, lymphatic system, cervix, vagina, prostate, mouth, tongue, etc.) are obtained or removed from the subject and contacted with an amount of a selected binding protein provided herein that is effective in prophylactically or therapeutically treating the disease, disorder, or other condition. The contacted cells are then returned or delivered to the subject to the site from which they were obtained or to another site (e.g., including those defined above) of interest in the subject to be treated. If desired, the contacted cells can be grafted onto a tissue, organ, or system site (including all described above) of interest in the subject using standard and well-known grafting techniques or, e.g., delivered to the blood or lymph system using standard delivery or transfusion techniques.

Also provided are in vivo methods in which one or more cells or a population of cells of interest of the subject are contacted directly or indirectly with an amount of a selected binding protein disclosed herein effective in prophylactically or therapeutically treating the disease, disorder, or other condition. In direct contact/administration formats, the selected binding protein is typically administered or transferred directly to the cells to be treated or to the tissue site of interest (e.g., tumor cells, tumor tissue sample, organ cells, blood cells, cells of the skin, lung, heart, muscle, brain, mucosae, liver, intestine, spleen, stomach, lymphatic system, cervix, vagina, prostate, mouth, tongue, etc.) by any of a variety of formats, including topical administration, injection (e.g., by using a needle or syringe), or vaccine or gene gun delivery, pushing into a tissue, organ, or skin site. The selected binding protein can be delivered, for example, intramuscularly, intradermally, subdermally, subcutaneously, orally, intraperitoneally, intrathecally, intravenously, or placed within a cavity of the body (including, e.g., during surgery), or by inhalation or vaginal or rectal administration. Exemplary delivery include, e.g., oral delivery (buccal or intestinal uptake/delivery), home injection (e.g., formulated in about a 1.4 ml volume or less), transdermal uptake/delivery, subcutaneously implantable pump, pulmonary uptake/delivery (systemic or non-systemic), blood-brain-barrier uptake/delivery, and/or nasal uptake/delivery.

Design approaches for oral delivery include, e.g., including in the binding protein a binding affinity for mucosal peptide transporters such as PepT1, PepT2, HPT1, ABC-family; addition of a translocation domain (PE38 or PE40 from Pseudomonas exotoxin A) to the binding protein; or including a binding affinity for blood-brain barrier transporters such as Transferrin receptor.

The four primary mechanisms for transepithelial delivery are:
(1) Transcellular: through the cell by diffusion: mostly used by small molecules.
(2) Paracellular: around the cells through desmosomes/tight junctions: mostly used by hydrophilic peptides
(3) Transcytosis: through the cells inside vesicles by pinocytosis
(4) Carrier- or Transporter-mediated, for molecules that bind to the transporter/carrier In another approach, the binding protein is designed to bind to receptors on the cell surface or inside vesicles that are actively transported across the cell to the serum, carrying the drug along. Such receptors are called Transporters. One such receptor is the neonatal immunoglobulin Fc receptor (FcRn) which can be used for pulmonary and intestinal delivery to the serum. Another receptor is the Transferrin receptor, which can transport across the blood-brain barrier into the cerebrospinal fluid. Alternatively, the monomer or multimer is designed to bind to the neonatal Fc receptor for pulmonary and intestinal transport. This method can comprise engineering the final drug product for pH sensitive release.

Considering the present disclosure, a range of strategies is possible. Binding proteins that bind known transporters (e.g., PepT1, HPT-1, PepT2, the ABC family, TAP1, TAP2, MDR) can be identified. Other useful binders can be identified by identifying monomers or multimers that bind to Caco2 cells (e.g., using an uptake blocking assay using $^{14}$C-Cephalexin uptake by Caco2 cells). See, e.g., Blanchette, J., et al. *Biomedicine and Pharmacotherapy* 58:142-151 (2004); Low, S. C., et al. *Human Reproduction*—advance access Apr. 7, 2005; Lee, V. J. *Natl Cancer Institute*, Monographs 29 (2001); Rubas, W., et al. *J. Pharm. Sci.* 85:165-169 (1996); Yang, C. Y., et al. *Pharmaceutical Research* 16:1331-1343 (1999); Dietrich, C. G., et al. *Gut* 52:1788-1799 (2003); Cleland, J. L., et al. *Current Opinion in Biotechnology* 12:212-219 (2001); Nielsen, C. U. and Brodin, B. *Current Drug Targets* 4:373-388 (2004); Kunta, J. R., et al. *Current Drug Metabolism* 5:109-124 (2004).

In another approach, a phage library of multimers can be applied to the oral cavity of a mammal and phage or DNA from the phage can be recovered in the serum of the animal to enrich for sequences that are good delivery agents. Natural domains or peptides that are known to be orally transported can also be fused to monomers or multimers disclosed herein. In yet another alternative, phage displayed domains are selected for resistance to the appropriate body fluid (nasal, intestinal, etc) or to purified proteases.

In in vivo indirect contact/administration formats, the selected binding protein is typically administered or transferred indirectly to the cells to be treated or to the tissue site of interest, including those described above (such as, e.g., skin cells, organ systems, lymphatic system, or blood cell system, etc), by contacting or administering the polypeptide directly to one or more cells or population of cells from which treatment can be facilitated. For example, tumor cells within the body of the subject can be treated by contacting cells of the blood or lymphatic system, skin, or an organ with a sufficient amount of the selected binding protein such that delivery of the selected binding protein to the site of interest (e.g., tissue, organ, or cells of interest or blood or lymphatic system within the body) occurs and effective prophylactic or therapeutic treatment results. Such contact, administration, or transfer is typically made by using one or more of the routes or modes of administration described above.

In another aspect, the present disclosure provides ex vivo methods in which one or more cells of interest or a population of cells of interest of the subject (e.g., tumor cells, tumor tissue sample, organ cells, blood cells, cells of the skin, lung, heart, muscle, brain, mucosae, liver, intestine, spleen, stomach, lymphatic system, cervix, vagina, prostate, mouth, tongue, etc.) are obtained or removed from the subject and transformed by contacting said one or more cells or population of cells with a polynucleotide construct comprising a nucleic acid sequence disclosed herein that encodes a biologically active binding protein of interest (e.g., a selected monomer domain and/or multimer) that is effective in prophylactically or therapeutically treating the disease, disorder, or other condition. The one or more cells or population of cells is contacted with a sufficient amount of the polynucleotide construct and a promoter controlling expression of said nucleic acid sequence such that uptake of the polynucleotide construct (and promoter) into the cell(s) occurs and sufficient expression of the target nucleic acid sequence results to produce an amount of the biologically active polypeptide, encoding a selected binding protein, effective to prophylactically or therapeutically treat the disease, disorder, or condition. The polynucleotide construct can comprise a promoter sequence (e.g., CMV promoter sequence) that controls expression of the nucleic acid sequence and/or, if desired, one or more additional nucleotide sequences encoding at least one or more of another polypeptide disclosed herein, a cytokine, adjuvant, or co-stimulatory molecule, or other polypeptide of interest.

Following transfection, the transformed cells are returned, delivered, or transferred to the subject to the tissue site or system from which they were obtained or to another site (e.g., tumor cells, tumor tissue sample, organ cells, blood cells, cells of the skin, lung, heart, muscle, brain, mucosae, liver, intestine, spleen, stomach, lymphatic system, cervix, vagina, prostate, mouth, tongue, etc.) to be treated in the subject. If desired, the cells can be grafted onto a tissue, skin, organ, or body system of interest in the subject using standard and well-known grafting techniques or delivered to the blood or lymphatic system using standard delivery or transfusion techniques. Such delivery, administration, or transfer of transformed cells is typically made by using one or more of the routes or modes of administration described above. Expression of the target nucleic acid occurs naturally or can be induced (as described in greater detail herein) and an amount of the encoded polypeptide is expressed sufficient and effective to treat the disease or condition at the site or tissue system.

In another aspect, also provided are in vivo methods in which one or more cells of interest or a population of cells of the subject (e.g., including those cells and cells systems and subjects described above) are transformed in the body of the subject by contacting the cell(s) or population of cells with (or administering or transferring to the cell(s) or population of cells using one or more of the routes or modes of administration described above) a polynucleotide construct comprising a nucleic acid sequence of the present disclosure that encodes a biologically active binding protein interest (e.g., a selected monomer domain and/or multimer) that is effective in prophylactically or therapeutically treating the disease, disorder, or other condition.

The polynucleotide construct can be directly administered or transferred to cell(s) suffering from the disease or disorder (e.g., by direct contact using one or more of the routes or modes of administration described above). Alternatively, the polynucleotide construct can be indirectly administered or transferred to cell(s) suffering from the disease or disorder by first directly contacting non-diseased cell(s) or other diseased cells using one or more of the routes or modes of administration described above with a sufficient amount of the polynucleotide construct comprising the nucleic acid sequence encoding the biologically active binding protein, and a promoter controlling expression of the nucleic acid sequence, such that uptake of the polynucleotide construct (and promoter) into the cell(s) occurs and sufficient expression of the nucleic acid sequence results to produce an amount of the biologically active binding protein effective to prophylactically or therapeutically treat the disease or disorder, and whereby the polynucleotide construct or the resulting expressed binding protein is transferred naturally or automatically from the initial delivery site, system, tissue or organ of the subject's body to the diseased site, tissue, organ or system of the subject's body (e.g., via the blood or lymphatic system). Expression of the target nucleic acid occurs naturally or can be induced (as described in greater detail below) such that an amount of expressed binding protein is sufficient and effective to treat the disease or condition at the site or tissue system. The polynucleotide construct can comprise a promoter sequence (e.g., CMV promoter sequence) that controls expression of the nucleic acid sequence and/or, if desired, one or more additional nucleotide sequences encoding at least one or more of another binding protein disclosed herein, a cytokine, adjuvant, or co-stimulatory molecule, or other binding protein of interest.

In each of the in vivo and ex vivo treatment methods as described herein, a composition comprising an excipient and the binding protein or nucleic acid of the present disclosure can be administered or delivered. In one aspect, a composition comprising a pharmaceutically acceptable excipient and a binding protein or nucleic acid disclosed herein is administered or delivered to the subject as described above in an amount effective to treat the disease or disorder.

In another aspect, in each in vivo and ex vivo treatment method described above, the amount of polynucleotide administered to the cell(s) or subject can be an amount such that uptake of said polynucleotide into one or more cells of the subject occurs and sufficient expression of said nucleic acid sequence results to produce an amount of a biologically active binding protein effective to enhance an immune response in the subject, including an immune response induced by an immunogen (e.g., an antigen). In another aspect, for each such method, the amount of binding protein administered to cell(s) or subject can be an amount sufficient to enhance an immune response in the subject, including that induced by an immunogen (e.g., an antigen).

In yet another aspect, in an in vivo or in vivo treatment method in which a polynucleotide construct (or composition comprising a polynucleotide construct) is used to deliver a physiologically active binding protein to a subject, the expression of the polynucleotide construct can be induced by using an inducible on- and off-gene expression system. Examples of such on- and off-gene expression systems include the Tet-On™ Gene Expression System and Tet-Off™ Gene Expression System (see, e.g., Clontech Catalog 2000, pg. 110-111 for a detailed description of each such system), respectively. Other controllable or inducible on- and off-gene expression systems are known to those of ordinary skill in the art. With such system, expression of the target nucleic acid of the polynucleotide construct can be regulated in a precise, reversible, and quantitative manner. Gene expression of the target nucleic acid can be induced, for example, after the stable transfected cells containing the polynucleotide construct comprising the target nucleic acid are delivered or transferred to or made to contact the tissue site, organ or system of interest. Such systems are of particular benefit in treatment methods and formats in which it is advantageous to delay or precisely control expression of the target nucleic acid (e.g., to allow time for completion of surgery and/or healing following surgery; to allow time for the polynucleotide construct comprising the target nucleic acid to reach the site, cells, system, or tissue to be treated; to allow time for the graft containing cells transformed with the construct to become incorporated into the tissue or organ onto or into which it has been spliced or attached, etc.).

X. Further Multimer Uses

The potential applications of multimers of the present disclosure are diverse and include any use where an affinity agent is desired, particularly a binding protein and more particularly a bispecific binding protein that binds to FGFR1c, β-Klotho or both FGFR1c and β-Klotho.

In some cases, a pair of monomers or multimers are selected to bind to the same target (i.e., for use in sandwich-based assays). To select a matched monomer or multimer pair, two different monomers or multimers typically are able to bind the target protein simultaneously. One approach to identify such pairs involves the following:

(1) immobilizing the phage or protein mixture that was previously selected to bind the target protein (2) contacting the target protein to the immobilized phage or protein and washing;

(3) contacting the phage or protein mixture to the bound target and washing; and (4) eluting the bound phage or protein without eluting the immobilized phage or protein.

One use of the multimers or monomer domains provided herein is to replace antibodies or other affinity agents in detection or other affinity-based assays. Thus, in some embodiments, monomer domains or multimers are selected against the ability to bind components other than a target in a mixture. The general approach can include performing the affinity selection under conditions that closely resemble the conditions of the assay, including mimicking the composition of a sample during the assay. Thus, a step of selection could include contacting a monomer domain or multimer to a mixture not including the target ligand and selecting against any monomer domains or multimers that bind to the mixture. Thus, the mixtures (absent the target ligand, which could be depleted using an antibody, monomer domain or multimer) representing the sample in an assay (serum, blood, tissue, cells, urine, semen, etc) can be used as a blocking agent. Such an approach can be desirable, for example, to create pharmaceutical proteins that bind to their target but not to other serum proteins or non-target tissues.

For example, agonists can be created, such as those described herein, in which the selected monomer domains or multimers mimic signaling events that arise from the in vivo association of two proteins, e.g., FGFR1c and β-Klotho. See FIG. 1. Optionally, the methods disclosed herein can be employed to generate antagonists. For example, multimers binding two different proteins, e.g., enzyme and substrate, can inhibit protein function, including, for example, enzymatic activity and/or substrate conversion.

In some embodiments, the monomer domains are used for ligand inhibition, ligand clearance or ligand stimulation. Possible ligands in these methods can include, e.g., FGFR1c and/or β-Klotho.

In another embodiment, a multimer comprising at least two monomers that bind to receptors is used to bring two receptors into proximity by both binding the multimer, thereby activating the receptors. A subset of the binding proteins described herein behave in this fashion. See, e.g., Example 11.

Further examples of potential uses of the compositions disclosed herein include monomer domains, and multimers thereof, that are capable of drug binding (e.g., binding radionucleotides for targeting, pharmaceutical binding for half-life extension of drugs, controlled substance binding for overdose treatment and addiction therapy), immune function modulating (e.g., immunogenicity blocking by binding such receptors as CTLA-4, immunogenicity enhancing by binding such receptors as CD80, or complement activation by Fc type binding), and specialized delivery (e.g., slow release by linker cleavage, electrotransport domains, dimerization domains, or specific binding to: cell entry domains, clearance receptors such as FcR, oral delivery receptors such as pIgR for transmucosal transport, and blood-brain transfer receptors such as transferrinR).

In further embodiments, monomers or multimers can be covalently linked to a detectable label (e.g., Cy3, Cy5, etc.) or expressed as a fusion polypeptide fused to a reporter gene product (e.g., CAT, luciferase, horseradish peroxidase, alkaline phosphotase, GFP, etc.).

XI. Further Manipulating Monomer Domains and/or Multimer Nucleic Acids and Polypeptides As described herein, the binding proteins of the present disclosure can be altered. Descriptions of a variety of diversity generating procedures for generating modified or altered nucleic acid sequences encoding these binding proteins are described herein and the references provided.

Another aspect of the present disclosure includes the cloning and expression of monomer domains, selected monomer domains, multimers and/or selected multimers coding nucleic acids. Thus, multimer domains can be synthesized as a single protein using expression systems well known in the art. General texts which describe molecular biological techniques useful herein, including the use of vectors, promoters and many other topics relevant to expressing nucleic acids such as monomer domains, selected monomer domains, multimers and/or selected multimers, include Berger and Kimmel, *Guide to Molecular Cloning Techniques, Methods in Enzymology* volume 152 Academic Press, Inc., San Diego, Calif. (Berger); Sambrook et al., *Molecular Cloning—A Laboratory Manual* (2nd Ed.), Vol. 1-3, Cold Spring Harbor Laboratory, Cold Spring Harbor, N.Y., 1989 and *Current Protocols in Molecular Biology*, F. M. Ausubel et al., eds., Current Protocols, a joint venture between Greene Publishing Associates, Inc. and John Wiley & Sons, Inc. Examples of techniques sufficient to direct persons of skill through in vitro amplification methods, useful in identifying, isolating and cloning monomer domains and multimers coding nucleic acids, including the polymerase chain reaction (PCR) the ligase chain reaction (LCR), Q-replicase amplification and other RNA polymerase mediated techniques (e.g., NASBA), are found in Berger, Sambrook, and Ausubel, as well as Mullis et al., (1987) U.S. Pat. No. 4,683,202; *PCR Protocols A Guide to Methods and Applications* (Innis et al. eds) Academic Press Inc. San Diego, Calif. (1990) (Innis); Arnheim & Levinson (Oct. 1, 1990) *C&EN* 36-47; *The Journal Of NIH Research* (1991) 3, 81-94; (Kwoh et al. (1989) *Proc. Natl. Acad. Sci. USA* 86, 1173; Guatelli et al. (1990) *Proc. Natl.*

*Acad. Sci. USA* 87, 1874; Lomell et al. (1989) *J. Clin. Chem* 35, 1826; Landegren et al., (1988) *Science* 241, 1077-1080; Van Brunt (1990) *Biotechnology* 8, 291-294; Wu and Wallace, (1989) *Gene* 4, 560; Barringer et al. (1990) *Gene* 89, 117, and Sooknanan and Malck (1995) *Biotechnology* 13: 563-564. Improved methods of cloning in vitro amplified nucleic acids are described in Wallace et al., U.S. Pat. No. 5,426,039. Improved methods of amplifying large nucleic acids by PCR are summarized in Cheng et al. (1994) *Nature* 369: 684-685 and the references therein, in which PCR amplicons of up to 40 kb are generated. One of skill will appreciate that essentially any RNA can be converted into a double stranded DNA suitable for restriction digestion, PCR expansion and sequencing using reverse transcriptase and a polymerase. See, e.g., Ausubel, Sambrook and Berger.

The present disclosure also relates to the introduction of vectors of the present disclosure into host cells, and the production of monomer domains, selected monomer domains, multimers and/or selected multimers of the present disclosure by recombinant techniques. Host cells are genetically engineered (i.e., transduced, transformed or transfected) with the vectors of the present disclosure, which can be, for example, a cloning vector or an expression vector. The vector can be, for example, in the form of a plasmid, a viral particle, a phage, etc. The engineered host cells can be cultured in conventional nutrient media modified as appropriate for activating promoters, selecting transformants, or amplifying the monomer domain, selected monomer domain, multimer and/or selected multimer gene(s) of interest. The culture conditions, such as temperature, pH and the like, are those previously used with the host cell selected for expression, and will be apparent to those skilled in the art and in the references cited herein, including, e.g., Freshney (1994) *Culture of Animal Cells, a Manual of Basic Technique*, third edition, Wiley-Liss, New York and the references cited therein.

As mentioned above, the binding proteins of the present disclosure can also be produced in non-animal cells such as plants, yeast, fungi, bacteria and the like. Indeed, as noted throughout, phage display is an especially relevant technique for producing such polypeptides. In addition to Sambrook, Berger and Ausubel, details regarding cell culture can be found in Payne et al. (1992) *Plant Cell and Tissue Culture in Liquid Systems* John Wiley & Sons, Inc. New York, N.Y.; Gamborg and Phillips (eds) (1995) *Plant Cell, Tissue and Organ Culture*; Fundamental Methods Springer Lab Manual, Springer-Verlag (Berlin Heidelberg New York) and Atlas and Parks (eds) *The Handbook of Microbiological Media* (1993) CRC Press, Boca Raton, Fla.

The present disclosure also provides for alterations of monomer domains, immuno-domains and/or multimers to improve pharmacological properties, to reduce immunogenicity, or to facilitate the transport of the multimer and/or monomer domain into a cell or tissue (e.g., through the blood-brain barrier, or through the skin). These types of alterations include a variety of modifications (e.g., the addition of sugar-groups or glycosylation), the addition of PEG, the addition of protein domains that bind a certain protein (e.g., HSA or other serum protein), the addition of proteins fragments or sequences that signal movement or transport into, out of and through a cell, the addition of proteins or protein domains (e.g. HSA or the Fc domain of IgG) that can extend the half-life of the multimer in serum. Additional components can also be added to a multimer and/or monomer domain to manipulate the properties of the multimer and/or monomer domain. A variety of components can also be added including, e.g., a domain that binds a known receptor (e.g., a Fc-region protein domain that binds a Fc receptor), a toxin(s) or part of a toxin, a prodomain that can be optionally cleaved off to activate the multimer or monomer domain, a reporter molecule (e.g., green fluorescent protein), a component that bind a reporter molecule (such as a radionuclide for radiotherapy, biotin or avidin) or a combination of modifications.

XII. Animal Models

Another aspect of the present disclosure is the development of specific non-human animal models in which to test the immunogenicity of binding proteins comprising monomer or multimer domains. The method of producing such non-human animal model comprises: introducing into at least some cells of a recipient non-human animal, vectors comprising genes encoding a plurality of human proteins from the same family of proteins, wherein the genes are each operably linked to a promoter that is functional in at least some of the cells into which the vectors are introduced such that a genetically modified non-human animal is obtained that can express the plurality of human proteins from the same family of proteins.

Suitable non-human animals employed in the practice of the methods and composition disclosed herein include all vertebrate animals, except humans (e.g., mouse, rat, rabbit, sheep, and the like). Typically, the plurality of members of a family of proteins includes at least two members of that family, and usually at least ten family members. In some embodiments, the plurality includes all known members of the family of proteins. Exemplary genes that can be used include those encoding monomer domains, such as, for example, members of the LDL receptor class A-domain family, the EGF-like domain family, as well as the other domain families described herein.

The non-human animal models of the present disclosure can be used to screen for immunogenicity of a binding protein comprising a monomer or multimer domain that is derived from the same family of proteins expressed by the non-human animal model. The present disclosure includes the non-human animal model made in accordance with the method described above, as well as transgenic non-human animals whose somatic and germ cells contain and express DNA molecules encoding a plurality of human proteins from the same family of proteins (such as the monomer domains described herein), wherein the DNA molecules have been introduced into the transgenic non-human animal at an embryonic stage, and wherein the DNA molecules are each operably linked to a promoter in at least some of the cells in which the DNA molecules have been introduced.

An example of a mouse model useful for screening LDL receptor class A-domain derived binding proteins is described as follows. Gene clusters encoding the wild type human LDL receptor class A-domain monomers are amplified from human cells using PCR. Almost all of the 200 different A-domains can be amplified with only three separate PCR amplification reactions of about 7 kb each. These fragments are then used to generate transgenic mice according to the method described above. The transgenic mice will recognize the human A-domains as "self," thus mimicking the "selfness" of a human with regard to A-domains. Individual A-domain-derived monomers or multimers are tested in these mice by injecting the A-domain-derived monomers or multimers into the mice, then analyzing the immune response (or lack of response) generated. The mice are tested to determine if they have developed a mouse anti-human response (MAHR). Monomers and multimers that do not result in the generation of a MAHR are likely to be non-immunogenic when administered to humans.

Historically, the MAHR test in transgenic mice is used to test individual proteins in mice that are transgenic for that single protein. In contrast, the above described method provides a non-human animal model that recognizes an entire family of human proteins as "self," and that can be used to evaluate a huge number of variant proteins that each are capable of vastly varied binding activities and uses.

XIII. Kits

Kits comprising components that can be employed in the disclosed methods (typically in an unmixed form), and packaging materials, instructions for using the components and/or performing the methods, and one or more containers for holding the components (reaction tubes, columns, etc.) form an aspect of the present disclosure. Kits comprising compounds and methods described herein can comprise a multimer library, or a binding protein comprising a single type of monomer or multimer, e.g., one or more of the FGFR1c and/or β-Klotho binding proteins described herein. Kits can also include reagents suitable for promoting target molecule binding, such as buffers or reagents that facilitate detection, including detectably-labeled molecules. Standards for calibrating a ligand binding to a monomer domain or the like, can also be included in the kits.

The present disclosure also provides commercially valuable binding assays and kits to practice the assays. In some of the assays, one or more ligand is employed to detect binding of a monomer domain, immuno-domains and/or multimer. Such assays are based on any known method in the art, e.g., flow cytometry, fluorescent microscopy, plasmon resonance, and the like, to detect binding of a ligand(s) to the binding protein.

Kits based on disclosed assays are also provided. Such a kit can comprise a container, and one or more ligand. A kit can also comprise directions for performing the assays, additional detection reagents, buffers, or instructions for the use of any of these components, or the like. Alternatively, kits can include cells, vectors, (e.g., expression vectors, secretion vectors comprising a polypeptide disclosed herein), for the expression of a binding protein of the present disclosure.

In a further aspect, the use of any composition, monomer domain, immuno-domain, multimer, cell, cell culture, apparatus, apparatus component or kit provided herein, for the practice of any method or assay herein, and/or for the use of any apparatus or kit to practice any assay or method herein and/or for the use of cells, cell cultures, compositions or other features herein as a therapeutic formulation is provided. The manufacture of all components herein as therapeutic formulations for the treatments described herein is also provided.

XIV. Integrated Systems

The present disclosure provides computers, computer readable media and integrated systems comprising character strings corresponding to monomer domains, selected monomer domains, multimers and/or selected multimers and nucleic acids encoding such binding proteins. These sequences can be manipulated by in silico recombination methods, or by standard sequence alignment or word processing software.

For example, different types of similarity and considerations of various stringency and character string length can be detected and recognized in the integrated systems herein. For example, many homology determination methods have been designed for comparative analysis of sequences of biopolymers, for spell checking in word processing, and for data retrieval from various databases. With an understanding of double-helix pair-wise complement interactions among four principal nucleobases in natural polynucleotides, models that simulate annealing of complementary homologous polynucleotide strings can also be used as a foundation of sequence alignment or other operations typically performed on the character strings corresponding to the sequences herein (e.g., word-processing manipulations, construction of figures comprising sequence or subsequence character strings, output tables, etc.). An example of a software package with GOs for calculating sequence similarity is BLAST, which can be adapted by inputting character strings corresponding to the sequences herein.

BLAST is described in Altschul et al., (1990) *J. Mol. Biol.* 215:403-410. Software for performing BLAST analyses is publicly available through the National Center for Biotechnology Information. This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul et al., supra). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, a cutoff of 100, M=5, N=−4, and a comparison of both strands. For amino acid sequences, the BLASTP program uses as defaults a wordlength (W) of 3, an expectation (E) of 10, and the BLOSUM62 scoring matrix (see Henikoff & Henikoff (1989) *Proc. Natl. Acad. Sci. USA* 89:10915).

An additional example of a useful sequence alignment algorithm is PILEUP. PILEUP creates a multiple sequence alignment from a group of related sequences using progressive, pairwise alignments. It can also plot a tree showing the clustering relationships used to create the alignment. PILEUP uses a simplification of the progressive alignment method of Feng & Doolittle, (1987) *J. Mol. Evol.* 35:351-360. The method used is similar to the method described by Higgins & Sharp, (1989) *CABIOS* 5:151-153. The program can align, e.g., up to 300 sequences of a maximum length of 5,000 letters. The multiple alignment procedure begins with the pairwise alignment of the two most similar sequences, producing a cluster of two aligned sequences. This cluster can then be aligned to the next most related sequence or cluster of aligned sequences. Two clusters of sequences can be aligned by a simple extension of the pairwise alignment of two individual sequences. The final alignment is achieved by a series of progressive, pairwise alignments. The program can also be used to plot a dendogram or tree representation of clustering relationships. The program is run by designating specific sequences and their amino acid or nucleotide coordinates for regions of sequence comparison. For example, in order to determine conserved amino acids in a monomer domain family or to compare the sequences of monomer domains in a family, the sequence in question, or coding nucleic acids, are aligned to provide structure-function information.

In one aspect, the computer system is used to perform "in silico" sequence recombination or shuffling of character strings corresponding to the monomer domains. A variety of such methods are set forth in "Methods For Making Character Strings, Polynucleotides & Polypeptides Having Desired Characteristics" by Selifonov and Stemmer, filed Feb. 5, 1999 (U.S. Ser. No. 60/118,854) and "Methods For Making Character Strings, Polynucleotides & Polypeptides Having Desired Characteristics" by Selifonov and Stemmer, filed Oct. 12, 1999 (U.S. Ser. No. 09/416,375). In brief, genetic operators are used in genetic algorithms to change given sequences, e.g., by mimicking genetic events such as mutation, recombination, death and the like. Multi-dimensional analysis to optimize sequences can be also be performed in the computer system, e.g., as described in the '375 application.

A digital system can also instruct an oligonucleotide synthesizer to synthesize oligonucleotides, e.g., used for gene reconstruction or recombination, or to order oligonucleotides from commercial sources (e.g., by printing appropriate order forms or by linking to an order form on the Internet).

The digital system can also include output elements for controlling nucleic acid synthesis (e.g., based upon a sequence or an alignment of a recombinant, e.g., recombined, monomer domain as herein), i.e., an integrated system of the present disclosure optionally includes an oligonucleotide synthesizer or an oligonucleotide synthesis controller. The system can include other operations that occur downstream from an alignment or other operation performed using a character string corresponding to a sequence herein, e.g., as noted above with reference to assays.

EXAMPLES

While the foregoing invention has been described in some detail for purposes of clarity and understanding, it will be clear to one skilled in the art from a reading of this disclosure that various changes in form and detail can be made without departing from the true scope of the invention. For example, all the techniques, methods, compositions, apparatus and systems described above can be used in various combinations. All publications, patents, patent applications, or other documents cited in this application are incorporated by reference in their entirety for all purposes to the same extent as if each individual publication, patent, patent application, or other document were individually indicated to be incorporated by reference for all purposes. PCT applications PCT/US02/13257 and PCT/US03/35664 and U.S. Patent Publication No. 2005/0089932 are hereby incorporated by reference in their entirety.

Example 1

This example describes selection of monomer domains and the creation of multimers.

Starting materials for identifying monomer domains and creating multimers from the selected monomer domains and procedures can be derived from any of a variety of human and/or non-human sequences. For example, to produce a selected monomer domain with specific binding for a desired ligand or mixture of ligands, one or more monomer domain gene(s) are selected from a family of monomer domains that bind to a certain ligand. The nucleic acid sequences encoding the one or more monomer domain gene can be obtained by PCR amplification of genomic DNA or cDNA, or optionally, can be produced synthetically using overlapping oligonucleotides.

Most commonly, these sequences are then cloned into a cell surface display format (i.e., bacterial, yeast, or mammalian (COS) cell surface display; phage display) for expression and screening. The recombinant sequences are transfected (transduced or transformed) into the appropriate host cell where they are expressed and displayed on the cell surface. For example, the cells can be stained with a labeled (e.g., fluorescently labeled), desired ligand. The stained cells are sorted by flow cytometry, and the selected monomer domains encoding genes are recovered (e.g., by plasmid isolation, PCR or expansion and cloning) from the positive cells. The process of staining and sorting can be repeated multiple times (e.g., using progressively decreasing concentrations of the desired ligand until a desired level of enrichment is obtained). Alternatively, any screening or detection method known in the art that can be used to identify cells that bind the desired ligand or mixture of ligands can be employed.

The selected monomer domain encoding genes recovered from the desired ligand or mixture of ligands binding cells can be optionally recombined according to any of the methods described herein or in the cited references. The recombinant sequences produced in this round of diversification are then screened by the same or a different method to identify recombinant genes with improved affinity for the desired or target ligand. The diversification and selection process is optionally repeated until a desired affinity is obtained.

The selected monomer domain nucleic acids selected by the methods can be joined together via a linker sequence to create multimers, e.g., by the combinatorial assembly of nucleic acid sequences encoding selected monomer domains by DNA ligation, or optionally, PCR-based, self-priming overlap reactions. The nucleic acid sequences encoding the multimers are then cloned into a cell surface display format (i.e., bacterial, yeast, or mammalian (COS) cell surface display; phage display) for expression and screening. The recombinant sequences are transfected (transduced or transformed) into the appropriate host cell where they are expressed and displayed on the cell surface. For example, the cells can be stained with a labeled, e.g., fluorescently labeled, desired ligand or mixture of ligands. The stained cells are sorted by flow cytometry, and the selected multimers encoding genes are recovered (e.g., by PCR or expansion and cloning) from the positive cells. Positive cells include multimers with an improved avidity or affinity or altered specificity to the desired ligand or mixture of ligands compared to the selected monomer domain(s). The process of staining and sorting can be repeated multiple times (e.g., using progressively decreasing concentrations of the desired ligand or mixture of ligands until a desired level of enrichment is obtained). Alternatively, any screening or detection method known in the art that can be used to identify cells that bind the desired ligand or mixture of ligands can be employed.

The selected multimer encoding genes recovered from the desired ligand or mixture of ligands binding cells can be optionally recombined according to any of the methods described herein or in the cited references. The recombinant sequences produced in this round of diversification are then screened by the same or a different method to identify recombinant genes with improved avidity or affinity or altered specificity for the desired or target ligand. The diversification and selection process is optionally repeated until a desired avidity or affinity or altered specificity is obtained.

Example 2

This example describes in vivo intra-protein recombination to generate libraries of greater diversity.

A monomer-encoding plasmid vector (pCK-derived vector; see below), flanked by orthologous loxP sites, was recombined in a Cre-dependent manner with a phage vector via its compatible loxP sites. The recombinant phage vectors were detected by PCR using primers specific for the recombinant construct. DNA sequencing indicated that the correct recombinant product was generated.

Reagents and Experimental Procedures pCK-cre-lox-Monomer-loxP. This vector has two particularly relevant features. First, it carries the cre gene, encoding the site-specific DNA recombinase Cre, under the control of $P_{lac}$. Cre was PCR-amplified from p705-cre (from GeneBridges) with cre-specific primers that incorporated XbaI (5') and SfiI (3') at the ends of the PCR product. This product was digested with XbaI and SfiI and cloned into the identical sites of pCK, a bla⁻, $Cm^R$ derivative of pCK110919-HC-Bla (pACYC ori), yielding pCK-cre.

The second feature is the naïve A domain library flanked by two orthologous loxP sites, loxP(wild-type) and loxP(FAS), which are required for the site-specific DNA recombination catalyzed by Cre. See, e.g., Siegel, R. W., et al. FEBS Letters 505:467-473 (2001). These sites rarely recombine with another. loxP sites were built into pCK-cre sequentially. 5'-phosphorylated oligonucleotides loxP(K) and loxP(K_rc), carrying loxP(WT) and EcoRI and HinDIII-compatible overhangs to allow ligation to digested EcoRI and HinDIII-digested pCK, were hybridized together and ligated to pCK-cre in a standard ligation reaction (T4 ligase; overnight at 16° C.).

The resulting plasmid was digested with EcoRI and SphI and ligated to the hybridized, 5'-phosphorylated oligos loxP (L) and loxP (L_rc), which carry loxP(FAS) and EcoRI and SphI-compatible overhangs. To prepare for library construction, a large-scale purification (Qiagen MAXI prep) of pCK-cre-lox-P(wt)-loxP(FAS) was performed according to Qiagen's protocol. The Qiagen-purified plasmid was subjected to CsCl gradient centrifugation for further purification. This construct was then digested with SphI and BglII and ligated to digested naïve A domain library insert, which was obtained via a PCR-amplification of a preexisting A domain library pool. By design, the loxP sites and monomer are in-frame, which generates monomers with loxP-encoded linkers. This library was utilized in the in vivo recombination procedure as detailed below.

fUSE5HA-Monomer-lox-lox vector. The vector is a derivative of fUSE5 from George Smith's laboratory (University of Missouri). It was subsequently modified to carry an HA tag for immunodetection assays. loxP sites were built into fUSE5HA sequentially. 5'-phosphorylated oligonucleotides loxP(I) and loxP(I)_rc, carrying loxP(WT), a string of stop codons and XmaI and SfiI-compatible overhangs, were hybridized together and ligated to XmaI- and SfiI-digested fUSE5HA in a standard ligation reaction (New England Biolabs T4 ligase; overnight at 16° C.).

The resulting phage vector was next digested with XmaI and SphI and ligated to the hybridized oligos loxP(J) and loxP(J)_rc, which carry loxP(FAS) and overhangs compatible with XmaI and SphI. This construct was digested with XmaI/SfiI and then ligated to pre-cut (XmaI/SfiI) naïve A domain library insert (PCR product). The stop codons are located between the loxP sites, preventing expression of gIII and consequently, the production of infectious phage.

The ligated vector/library was subsequently transformed into an *E. coli* host bearing a gIII-expressing plasmid that allows the rescue of the fUSE5HA-Monomer-lox-lox phage, as detailed below.

pCK-gIII. This plasmid carries gIII under the control of its native promoter. It was constructed by PCR-amplifying gIII and its promoter from VCSM13 helper phage (Stratagene) with primers gIIIPromoter_EcoRI and gIIIPromoter_HinDIII. This product was digested with EcoRI and HinDIII and cloned into the same sites of pCK110919-HC-Bla. As gIII is under the control of its own promoter, gIII expression is presumably constitutive. pCK-gIII was transformed into *E. coli* EC100 (Epicentre).

In vivo recombination procedure. In summary, the procedure involves the following key steps: a) Production of infective (i.e., rescue) of fUSE5HA-Monomer-lox-lox library with an *E. coli* host expressing gIII from a plasmid; b) Cloning of $2^{nd}$ library (pCK) and transformation into F⁺ TG 1 *E. coli*; c) Infection of the culture carrying the $2^{nd}$ library with the rescued fUSE5HA-Monomer-lox-lox phage library.

a. Rescue of phage vector. Electrocompetent cells carrying pCK-gIII were prepared by a standard protocol. These cells had a transformation frequency of $4 \times 10^8/\mu g$ DNA and were electroporated with large-scale ligations (~5 μg vector DNA) of fUSE5HA-lox-lox vector and the naïve A domain library insert. After individual electroporations (100 ng DNA/electroporation) with ~70 μL cells/cuvette, 930 μL warm SOC media were added, and the cells were allowed to recover with shaking at 37 C for 1 hour. Next, tetracycline was added to a final concentration of 0.2 μg/mL, and the cells were shaken for ~45 minutes at 37 C. An aliquot of this culture was removed, 10-fold serially diluted and plated to determine the resulting library size ($1.8 \times 10^7$). The remaining culture was diluted into 2×500 mL 2×YT (with 20 μg/mL chloramphenicol and 20 μg/mL tetracycline to select for pCK-gIII and the fUSE5HA-based vector, respectively) and grown overnight at 30 C.

Rescued phage were harvested using a standard PEG/NaCl precipitation protocol. The titer was approximately $1 \times 10^{12}$ transducing units/mL.

b. Cloning of the $2^{nd}$ library and transformation into an *E. coli* host. The ligated pCK/naïve A domain library is electroporated into a bacterial F⁺ host, with an expected library size of approximately $10^8$. After an hour-long recovery period at 37 C with shaking, the electroporated cells are diluted to $OD_{600}$~0.05 in 2×YT (plus 20 μg/mL chloramphenicol) and grown to mid-log phase at 37 C before infection by fUSEHA-Monomer-lox-lox.

c. Infection of the culture carrying the $2^{nd}$ library with the rescued fUSE5HA-Monomer-lox-lox phage library. To maximize the generation of recombinants, a high infection rate (>50%) of *E. coli* within a culture is desirable. The infectivity of *E. coli* depends on a number of factors, including the expression of the F pilus and growth conditions. *E. coli* backgrounds TG1 (carrying an F') and K91 (an Hfr strain) were hosts for the recombination system.

Oligonucleotides

```
loxP(K)
[P-5' agcttataacttcgtatagaaaggtatatacgaagttatagatctcgtgctgcatgcggtgcg]        (SEQ ID NO: 395)

loxP(K_rc)
[P-5' aattcgcaccgcatgcagcacgagatctataacttcgtatataccttctatacgaagttataagct]     (SEQ ID NO: 396)
```

```
loxP(L)
[P-5' ataacttcgtatagcatacattatacgaagttatcgag]                                              (SEQ ID NO: 397)

loxP (L_rc)
[P-5' ctcgataacttcgtataatgtatgctatacgaagttatg]                                             (SEQ ID NO: 398)

loxP(I)
[P5'ccgggagcagggcatgctaagtgagtaataagtgagtaaataacttcgtatataccttctatacgaagttatcgtctg]        (SEQ ID NO: 399)

loxP(I)_rc
[P-5' acgataacttcgtatagaaaggtatatacgaagttatttactcacttattactcacttagcatgccctgetc]            (SEQ ID NO: 400)

loxP(J)
[5' ccgggaccagtggcctctggggccataacttcgtatagcatacattatacgaagttatg]                           (SEQ ID NO: 401)

loxP(J)_rc
[5' cataacttcgtataatgtatgctatacgaagttatggccccagaggccactggtc]                               (SEQ ID NO: 402)

gIIIPromoter_EcoRI
[5' atggcgaattctcattgtcggcgcaactat]                                                        (SEQ ID NO: 403)

gIIIPromoter_HinDIII
[5' gataagctttcattaagactccttattacgcag]                                                     (SEQ ID NO: 404)
```

Example 3

This example describes construction of an EGF-based monomer library.

The CaEGF domain library, E3, encodes a protein domain of 36-43 amino acids having the following pattern:

(SEQ ID NO: 405)
$$X_{(5)}C_1-X_{(4/6)}-C_2-X_{(4,5)}-C_3-X_{(8)}-C_4-X_{(1)}-C_5-X_{(8/12)}-C_6$$

The table below describes for each position which amino acids are encoded in the library based upon the natural diversity of human calcium binding EGF domains:

TABLE 1

| X(5) | | | | | C1 | X(4,6) | | | | | | C2 | X(4,5) | | | | | C3 | X(8) | | | | | | | | C4 | X |
|---|---|---|---|---|---|---|---|---|---|---|---|---|---|---|---|---|---|---|---|---|---|---|---|---|---|---|---|---|
| X1 | X2 | X3 | X4 | X5 | | X1 | X2 | X3 | X4 | X5 | X6 | | X1 | X2 | X3 | X4 | X5 | | X1 | X2 | X3 | X4 | X5 | X6 | X7 | X8 | | X1 |
| V | D | V | N | E | | V | S | S | P | | | | V | S | G | S | | | V | N | T | V | G | S | T | S | | V |
| T | | I | D | | | S | P | G | A | D | A | | T | R | D | R | I | | Q | D | S | Q | | G | F | R | | S |
| I | | | | | | L | E | N | S | G | I | | S | N | N | Q | K | | L | | L | P | | | | Q | | R |
| K | | | | | | A | L | D | | H | L | | R | H | S | N | N | | K | | I | L | | | | K | | Q |
| E | | | | | | D | Q | I | | N | P | | Q | | | L | R | | I | | | E | | | | H | | N |
| A | | | | | | E | V | V | | R | T | | P | | | K | S | | E | | | A | | | | | | M |
| | | | | | | G | | | | S | V | | N | | | I | T | | | | | | | | | | | L |
| | | | | | | K | | | | | | | M | | | | H | | | | | | | | | | | K |
| | | | | | | N | | | | | | | L | | | A | | | | | | | | | | | | I |
| | | | | | | R | | | | | | | K | | | G | | | | | | | | | | | | H |
| | | | | | | T | | | | | | | I | | | | | | | | | | | | | | | G |
| | | | | | | | | | | | | | M | | | | | | | | | | | | | | | E |
| | | | | | | | | | | | | | G | | | | | | | | | | | | | | | D |
| | | | | | | | | | | | | | E | | | | | | | | | | | | | | | |
| | | | | | | | | | | | | | D | | | | | | | | | | | | | | | |
| | | | | | | | | | | | | | A | | | | | | | | | | | | | | | |

TABLE 1-continued

| | C5 | X1 | X2 | X3 | X4 | X5 | X6 | X7 | X8 | X9 | X10 | X11 | X12 | C6 |
|---|---|---|---|---|---|---|---|---|---|---|---|---|---|---|
| | | | | | | X(8,12) | | | | | | | | |
| | | V | Q | G | Y | T | | G | V | | | S | | |
| | | P | P | | F | S | L | T | R | A | G | K | A | |
| | | L | E | | | A | P | Q | N | D | R | N | D | |
| | | A | A | | | E | Q | P | L | N | S | R | E | |
| | | H | K | | | K | R | L | I | T | | S | G | |
| | | N | T | | | L | | K | H | | | T | K | |
| | | R | | | | M | | I | A | | | | N | |
| | | S | | | | P | | E | E | | | | R | |
| | | T | | | | Q | | A | G | | | | S | |
| | | | | | | V | | D | P | | | | T | |
| | | | | | | G | | Q | | | | | | |
| | | | | | | N | | | | | | | | |
| | | | | | | S | | | | | | | | |

The library of DNA sequences, E3, encoding monomeric calcium binding EGF domains, was created by assembly PCR as described in Stemmer et al., *Gene* 164:49-53 (1995). The oligonucleotides used in this PCR reaction are in two groups, Group 1 and Group 2. They are:

Group 1 (SEQ ID NOS 406-411, respectively, in order of appearance):

(SEQ ID NO: 406)
1. 5'-AAAAGGCCTCGAGGGCCTGGGTGGCAATGGT-3'

(SEQ ID NO: 407)
2. 5'-CCTGAACCACCACAKHKACCGYKSNBGCACGGAYYCGRCRMACA
TTCATYAAYATCTDYACCATTGCCACCC-3'

(SEQ ID NO: 408)
3. 5'-CCTGAACCACCACAKNTGSCGYYGYKMHSGCACGGAYYCGRCRM
ACATTCATYAAYATCTDYACCATTGCCACCC-3'

(SEQ ID NO: 409)
4. 5'-CCTGAACCACCACAKHKACCGYKSNBGCAARBAYBCGVAHYCWS
KBYACATTCATYAAYATCTDYACCATTGCCACCC-3'

(SEQ ID NO: 410)
5. 5'-CCTGAACCACCACAKNTGSCGYYGYKMHSGCAARBAYBCGVAHY
CWSKBYACATTCATYAAYATCTDYACCATTGCCACCC-3'

(SEQ ID NO: 411)
6. 5'-TGAATTTTCTGTATGAGGTTTTGCTAAACAACTTTCAACAGTTT
CGGCCCCAGAGGCCCTGGAGCCACCTGAACCACCACA-3'

Group 2 (SEQ ID NOS: 412-415, respectively, in order of appearance):

(SEQ ID NO: 412)
1. 5'-ACGGTGCCTACCCGTATGATGTTCCGGATTATGCCCCGGGTGG
CAATG GT-3'

(SEQ ID NO: 413)
2. 5'-CCTGAACCACCACAGHKTDBACCGGHAWAGCCTKSCRSGCASH
BACAKYKAWAGCYACCCDSTRWATYTWBACCATTGCCACCC-3'

(SEQ ID NO: 414)
3. 5'-CCTGAACCACCACAKBYKBTKCYGKYCBSABYCNGCDBAWAGC
CTKBGBKGCASHBACAKYKAWAGCYACCCDSTRWATYTWBACCATT
GCCACCC-3'

(SEQ ID NO: 415)
4. 5'-AAAAGGCCCCAGAGGCCCCTGAACCACCACA-3' where R=A/G, Y=C/T, M=A/C, K=G/T, S=C/G, W=A/T, B=C/G/T, D=A/G/T, H=A/C/T, V=A/C/G, and N=A/C/G/T.

Following the separate PCRs of the Group 1 and 2 oligonucleotides, the Group 1 PCR fragments were digested with BpmI and group 2 PCR fragments were digested with BsrDI. Digestion products were purified using Qiagen Qiaquick columns and then ligated together. The ligated DNA was then amplified in a PCR using two primers. The primers used were:

(SEQ ID NO: 416)
5'-AAAAGGCCTCGAGGGCCTGGGTGGCAATGGT-3'

(SEQ ID NO: 417)
5'-AAAAGGCCCCAGAGGCCCCTGAACCACCACA-3'

The PCR products were purified with Qiagen Qiaquick columns and digested with SfiI. The digested product was purified with Qiagen Qiaquick columns. The DNA fragments were ligated into the SfiI restriction sites of phage display vector fuse5-HA(G4S)4 (SEQ ID NO: 418), a derivative of fuse5 carrying an in-frame HA-epitope and a glycine, serine flexible linker. The ligation mixture was electroporated into TransforMax™ EC100™ electrocompetent *E. coli* cells. Transformed *E. coli* cells were grown overnight at 37° C. in 2×YT medium containing 20 µg/ml tetracycline. The resulting library contained 2×10$^9$ independent clones. Phage particles were purified from the culture medium by PEG-precipitation. The titer of the phage was 1.3×10$^{12}$/ml. The sequences of 24 individual clones were determined and these were consistent with the library design.

Example 4

This example describes in vitro intra-protein recombination to generate recombined libraries and method to generate libraries with randomized inter-cysteine loops.

Recombination can be used for intradomain optimization. For example a PCR overlap reaction can be used that recombines two or more segments of a single domain relative to each other. One can use two, three, four, five or more fragment overlap reactions in the same way as illustrated. This recombination process has many applications. One application is to recombine a large pool of hundreds of previously selected clones without sequence information. All that is needed for each overlap to work is one known region of (relatively) constant sequence that exists in the same location in each of the clones (fixed site approach). For A domains, typically these clones would have been derived from a library in which 20-25 amino acids distributed over all five inter-cysteine segments were randomized The intra-domain recombination method can also be performed on a pool of sequence-related monomer domains by standard DNA recombination (e.g., Stemmer, *Nature* 370:389-391 (1994)) based on random fragmentation and reassembly based on DNA sequence homology, which does not require a fixed overlap site in all of the clones that are to be recombined.

Another application of this process is to create multiple separate, naïve (meaning unpanned) libraries in each of which only one of the intercysteine loops is randomized, to randomize a different loop in each library. After panning of these libraries separately against the target, the selected clones are then recombined. From each panned library only the randomized segment is amplified by PCR and multiple randomized segments are then combined into a single domain, creating a shuffled library which is panned and/or screened for increased potency. This process can also be used to shuffle a small number of clones of known sequence.

Any common sequence can be used as a cross-over point. For A domains or other cysteine-containing monomers, the cysteine residues are logical places for the crossover. However, there are other ways to determine optimal crossover sites, such as computer modeling. Alternatively, residues with highest entropy, or the least number of intramolecular contacts, may also be good sites for crossovers.

An exemplary method of generating libraries comprised of proteins with randomized inter-cysteine loops is presented below. In this example, in contrast to the separate loop, separate library approach described above, multiple intercysteine loops are randomized simultaneously in the same library.

An A domain NNK library encoding a protein domain of 39-45 amino acids having the following pattern was constructed:

(SEQ ID NO: 419)
$C_1$-$X_{(4,6)}$-$E_1$-F-$R_1$-$C_2$-A-$X_{(2,4)}$-$G_1$-$R_2$-$C_3$-I-P-$S_1$-$S_2$-

W-V-$C_4$-$D_1$-$G_2$-$E_2$-$D_2$-$D_3$-$C_5$-$G_3$-$D_4$-$G_4$-$S_3$-$D_5$-$E_3$-$X_{(4,6)}$-

$C_6$;

where,
$C_1$-$C_6$: cysteines;
$X_{(n)}$: sequence of n amino acids with any residue at each position;
$E_1$-$E_3$: glutamine;
F: phenylalanine;
$R_1$-$R_2$: arginine;
A: alanine;
$G_1$-$G_4$: glycine;
I: isoleucine;
P: proline;
$S_1$-$S_3$: serine;
W: tryptophan;
V: valine;
$D_1$-$D_5$: aspartic acid; and
$C_1$-$C_3$, $C_2$-$C_5$ & $C_4$-$C_6$ form disulfides.

The library was constructed by creating a library of DNA sequences, containing tyrosine codons (TAT) or variable non-conserved codons (NNK), by assembly PCR as described in Stemmer et al., *Gene* 164:49-53 (1995). Compared to the native A-domain scaffold and the design that was used to construct library A1 (described previously) this approach: 1) keeps more of the existing residues in place instead of randomizing these potentially critical residues, and 2) inserts a string of amino acids of variable length of all 20 amino acids (NNK codon), such that the average number of inter-cysteine residues is extended beyond that of the natural A domain or the A1 library. The rate of tyrosine residues was increased by including tyrosine codons in the oligonucleotides, because tyrosines were found to be overrepresented in antibody binding sites, presumably because of the large number of different contacts that tyrosine can make. The oligonucleotides used in this PCR reaction are (SEQ ID NOS: 420-446, respectively, in order of appearance):

```
                                      (SEQ ID NO: 420)
1. 5'-ATATCCCGGGTCTGGAGGCGTCTGGTGGTTCGTGTNNKNNKNN

KNNKGAATTCCGA-3'

(SEQ ID NO: 421)
2. 5'-ATATCCCGGGTCTGGAGGCGTCTGGTGGTTCGTGTNNKNNKNN

KNNKNNKGAATTCCGA-3'

(SEQ ID NO: 422)
3. 5'-ATATCCCGGGTCTGGAGGCGTCTGGTGGTTCGTGTNNKNNKNN

KNNKNNKNNKGAATTCCGA-3'

(SEQ ID NO: 423)
4. 5'-ATATCCCGGGTCTGGAGGCGTCTGGTGGTTCGTGTTATNNKNN

KNNKGAATTCCGA-3'

(SEQ ID NO: 424)
5. 5'-ATATCCCGGGTCTGGAGGCGTCTGGTGGTTCGTGTNNKTATNN

KNNKNNKGAATTCCGA-3'

(SEQ ID NO: 425)
6. 5'-ATATCCCGGGTCTGGAGGCGTCTGGTGGTTCGTGTNNKTATNN

KNNKGAATTCCGA-3'
```

```
                                                    (SEQ ID NO: 426)
7.  5'-ATATCCCGGGTCTGGAGGCGTCTGGTGGTTCGTGTNNKNNKTA

TNNKGAATTCCGA-3'

(SEQ ID NO: 427)
8.  5'-ATATCCCGGGTCTGGAGGCGTCTGGTGGTTCGTGTNNKNNKNN

KTATGAATTCCGA-3'

(SEQ ID NO: 428)
9.  5'-ATATCCCGGGTCTGGAGGCGTCTGGTGGTTCGTGTNNKNNKNN

KTATNNKGAATTCCGA-3'

(SEQ ID NO: 429)
10. 5'-ATACCCAAGAAGACGGTATACATCGTCCMNNMNNTGCACATCG

GAATTC-3'

(SEQ ID NO: 430)
11. 5'-ATACCCAAGAAGACGGTATACATCGTCCMNNMNNMNNTGCACA

TCGGAATTC-3'

(SEQ ID NO: 431)
12. 5'-ATACCCAAGAAGACGGTATACATCGTCCMNNMNNMNNMNNTGC

ACATCGGAATTC-3'

(SEQ ID NO: 432)
13. 5'-ATACCCAAGAAGACGGTATACATCGTCCATAMNNMNNTGCAC

ATCGGAATTC-3'

(SEQ ID NO: 433)
14. 5'-ATACCCAAGAAGACGGTATACATCGTCCMNNATAMNNMNNTGC

ACATCGGAATTC-3'

(SEQ ID NO: 434)
15. 5'-ATACCCAAGAAGACGGTATACATCGTCCMNNATAMNNTGCACA

TCGGAATTC-3'

(SEQ ID NO: 435)
16. 5'-ATACCCAAGAAGACGGTATACATCGTCCMNNMNNATATGCACA

TCGGAATTC-3'

(SEQ ID NO: 436)
17. 5'-ATACCCAAGAAGACGGTATACATCGTCCMNNMNNATAMNNTGC

ACATCGGAATTC-3'

(SEQ ID NO: 437)
18. 5'-ACCGTCTTCTTGGGTATGTGACGGGGAGGACGATTGTGGTGAC

GGATCTGACGAG-3'

(SEQ ID NO: 438)
19. 5'-ATATGGCCCCAGAGGCCTGCAATGATCCACCGCCCCCACAMNN

MNNMNNMNNCTCGTCAGATCCGT-3'

(SEQ ID NO: 439)
20. 5'-ATATGGCCCCAGAGGCCTGCAATGATCCACCGCCCCCACAMNN

MNNMNNMNNMNNCTCGTCAGATCCGT-3'

(SEQ ID NO: 440)
21. 5'-ATATGGCCCCAGAGGCCTGCAATGATCCACCGCCCCCACAMNN

MNNMNNMNNMNNMNNCTCGTCAGATCCGT-3'

(SEQ ID NO: 441)
22. 5'-ATATGGCCCCAGAGGCCTGCAATGATCCACCGCCCCCACAATA

MNNMNNMNNCTCGTCAGATCCGT-3'

(SEQ ID NO: 442)
23. 5'-ATATGGCCCCAGAGGCCTGCAATGATCCACCGCCCCCACAMNN

ATAMNNMNNMNNCTCGTCAGATCCGT-3'

(SEQ ID NO: 443)
24. 5'-ATATGGCCCCAGAGGCCTGCAATGATCCACCGCCCCCACAMNN

ATAMNNMNNCTCGTCAGATCCGT-3'

(SEQ ID NO: 444)
25. 5'-ATATGGCCCCAGAGGCCTGCAATGATCCACCGCCCCCACAMNN

MNNATAMNNCTCGTCAGATCCGT-3'

(SEQ ID NO: 445)
26. 5'-ATATGGCCCCAGAGGCCTGCAATGATCCACCGCCCCCACAMNN

MNNMNNATACTCGTCAGATCCGT-3'

(SEQ ID NO: 446)
27. 5'-ATATGGCCCCAGAGGCCTGCAATGATCCACCGCCCCCACAMNN

MNNMNNATAMNNCTCGTCAGATCCGT-3'
``` where R=A/G, Y=C/T, M=A/C, K=G/T, S=C/G, W=A/T, B=C/G/T, D=A/G/T, H=A/C/T, V=A/C/G, and N=A/C/G/T The library was constructed though an initial round of 10 cycles of PCR amplification using a mixture of 4 pools of oligonucleotides, each pool containing 400 pmols of DNA. Pool 1 contained oligonucleotides 1-9, pool 2 contained 10-17, pool 3 contained only 18 and pool 4 contained 19-27. The fully assembled library was obtained through an additional 8 cycles of PCR using pool 1 and 4. The library fragments were digested with XmaI and SfiI. The DNA fragments were ligated into the corresponding restriction sites of phage display vector fuse5-HA, a derivative of fuse5 carrying an in-frame HA-epitope. The ligation mixture was electroporated into TransforMax™ EC100™ electrocompetent *E. coli* cells resulting in a library of $2 \times 10^9$ individual clones. Transformed *E. coli* cells were grown overnight at 37° C. in 2×YT medium containing 20 µg/ml tetracycline. Phage particles were purified from the culture medium by PEG-precipitation and a titer of $1.1 \times 10^{13}$/ml was determined Sequences of 24 clones were determined and were consistent with the expectations of the library design.

Example 5

This example describes optimization of multimers by optimizing monomers and/or linkers for binding to a target.

One approach for optimizing multimer binding to targets involves optimization of monomers, multimers and linkers. First a library of monomers is panned for binding to the target (e.g., FGFR1c or β-Klotho). However, some of the monomers may bind at locations on the target that are far away from each other, such that the domains that bind to these sites cannot be connected by a linker peptide. It is therefore useful to create and screen a large library of homo- or heterotrimers from these monomers before optimization of the monomers. These trimer libraries can be screened, e.g., on phage (typical for heterotrimers created from a large pool of monomers) or made and assayed separately (e.g., for homotrimers). By this method, the best trimer is identified. The assays can include binding assays to a target or agonist or antagonist potency determination of the multimer in functional protein- or cell-based assays.

The monomeric domain(s) of the single best trimer are then optimized as a second step. Homomultimers are easiest to optimize, since only one domain sequence exists, though heteromultimers can also be synthesized. For homomultimers, an increase in binding by the multimer compared to the monomer is an avidity effect.

After optimization of the domain sequence itself (e.g., by recombining or NNK randomization) and phage panning, the improved monomers are used to construct a dimer with a linker library. Linker libraries can be formed, e.g., from linkers with an NNK composition and/or variable sequence length.

After panning of this linker library, the best clones (e.g., determined by potency in the inhibition or other functional assay) are converted into multimers composed of multiple (e.g., two, three, four, five, six, seven, eight, etc.) sequence-optimized domains and length- and sequence-optimized linkers.

Example 6

This example describes a structural analysis of A domains.

As with virtually all proteins, only a small fraction of the total surface of an A-domain participates in binding a single target. Based on the solution structure of the domain, adjacent residue positions can be identified which are likely to be able to cooperate in binding to a given target. Herein, such groups of adjacent residues are referred to as structural categories. As an example, four such categories have been identified through examination of the A-domain structure, designated Top, Bottom, Loop 1, and Loop 2. By designing libraries which only allow diversity within a given category, the theoretical sequence space allowed by a library can be significantly reduced, allowing for better coverage of the theoretical space by the physical library. Further, in the case of non-overlapping categories such as the Top and Bottom categories, half-domain sequences selected against different targets can be combined into a single sequence which would be able to bind simultaneously or alternatively to the selected targets. In either case, creating binding sites that occupy only half a domain allows for the creation of molecules that are half as large and would have half the number of immunogenic epitopes, reducing the risk of immunogenicity.

Structural Classification of A-domain Positions

A canonical A-domain sequence (SEQ ID NO: 447) is shown below with high-diversity positions represented as an X. Positions that belong to either the Top, Bottom, Loop 1, or Loop 2 categories are designated with a star.

Phage libraries were panned through several rounds either on solid support (e.g., Nunc MaxiSorp plates or Dynal beads) or in solution (e.g., capturing with Dynal beads). Output phage pools with (a) the highest frequency of individual phage clones that bind to human FGFR1c (huFGFR1c) or recombinant human β-klotho (rhβ-klotho) and (b) high sequence diversity among the binding-positive phage clones were chosen for protein screening.

I. Round 1 (MaxiSorp Plates or Dynal Beads)

1. Coating Target huFGFR1c-Fc

A. Coating plates: Five or six wells for each A-domain library were directly coated with 50 nM huFGFR1c-Fc (R & D Systems) diluted in TBS[pH 7.5]/2 mM $CaCl_2$ (100 uL total volume/well) for 1-2 hours with shaking at room temperature. In addition, one negative control well/library was incubated with TBS[pH 7.5]/2 mM $CaCl_2$ only. For certain panning lineages, the libraries were pre-bound to Protein A beads coated with huIgG to subtract huIgG-binding phage. For certain other lineages, protein M10 (which binds to human Fc) was added to block the A1 library phage from binding to the M10 epitope of huFGFR1c-Fc during the phage binding incubation steps.

B. Coating beads: 20 μL Protein A beads (Dynal ASA) were incubated with 50 nM huFGFR1c-Fc in 500 uL TBS[pH 7.5]/2 mM $CaCl_2$ and rotated at room temperature for 1 hr in Eppendorf tubes. As a negative control, 20 μL Protein A beads without target were incubated in 500 μL of TBS[pH 7.5]/2 mM $CaCl_2$ and rotated at room temperature for 1 hr. Note that Dynal beads were washed at least twice with TBS [pH 7.5]/2 mM $CaCl_2$ before adding target, and beads were coated in bulk. For certain panning lineages, the libraries were pre-bound to huIgG to subtract huIgG-binding phage. For certain other lineages, protein M10 (which binds to human Fc) was added to block the A1 library phage from binding to the M10 epitope of huFGFR1c-Fc during the phage binding incubation steps. Three rounds of panning were conducted with a constant target concentration of 50 nM for some lineages. Other lineages employed a five-fold decease in target concentration (e.g., 50 nM for Round 1, 10 nM for Round 2 and 2 nM for Round 3) each round.

2. Coating Target Recombinant Human Beta-Klotho

A. Coating plates: Five or six wells for each library (A1, 1AJJ, DSL, and LNR) used in panning were directly coated with 50 nM or 100 nM (Round 1) recombinant human beta-klotho (rhβ-klotho) diluted in TBS[pH 7.5]/2 mM $CaCl_2$ (100 μL total volume/well) for 1-2 hours with shaking at room temperature. In addition, one negative control well/library was incubated with TBS[pH 7.5]/2 mM $CaCl_2$ only. For certain panning lineages, an anti-HIS tag antibody was

TABLE 2

| | 2 | 3 | 4 | 5 | 6 | 7 | 8 | 9 | 10 | 11 | 12 | 13 | 14 | 15 | 16 | 17 | 18 | 19 | 20 |
|---|---|---|---|---|---|---|---|---|---|---|---|---|---|---|---|---|---|---|---|
| | C | X | X | X | X | F | X | C | X | X | X | X | C | I | X | X | X | W | X |
| Top | • | o | • | • | o | • | • | • | • | • | • | o | • | o | o | • | o | o | • |
| Bottom | • | • | • | • | • | o | o | • | o | • | • | • | • | • | • | o | • | • | o |
| Loop 1 | • | o | o | o | o | • | • | • | • | • | • | • | • | • | o | o | o | • | • |
| Loop 2 | • | • | • | • | • | • | • | • | o | o | o | o | • | • | • | • | • | • | • |

| | 21 | 22 | 23 | 24 | 25 | 26 | 27 | 28 | 29 | 30 | 31 | 32 | 33 | 34 | 35 | 36 |
|---|---|---|---|---|---|---|---|---|---|---|---|---|---|---|---|---|
| | C | D | G | X | X | D | C | X | D | X | S | D | E | X | X | C |
| Top | • | o | o | o | o | o | • | o | • | o | • | • | • | • | • | • |
| Bottom | • | • | • | • | • | • | • | • | o | • | o | • | • | o | o | • |
| Loop 1 | • | • | • | • | • | • | • | • | • | • | • | • | • | • | • | • |
| Loop 2 | • | • | • | • | • | • | • | o | o | o | • | • | • | • | • | • |

Example 7

This example describes screening for monomers or multimers that bind human FGFR1c or human β-klotho.

coated first onto plates, followed by HIS-tagged rhβ-klotho, to present the target via the antibody. For certain panning lineages, immunoglobulin Fc-domain binders were subtracted from libraries using Protein A/FGFR1c-Fc before being applied to rhβ-klotho. For certain other lineages, Protein A coated onto plates was used to form complexes comprised of huFGFR1c-Fc (50 nM) and rhβ-klotho (250 nM) (Round 1); 10 nM/25 nM (Round 2); and 2 nM/5 nM (Round 3).

B. Coating beads: Recombinant human β-klotho-Fc fusion was immobilized on Protein A beads, Dyax StrepAvidin beads or on Invitrogen Talon Beads and was panned against libraries (A1, 1AJJ, DSL, and LNR). For certain panning lineages, Fc binders were subtracted from libraries using Protein A/IgG before being applied to rhβ-klotho while Strepavidin binders were subtracted from libraries using Strepavin beads. In addition, the preformed complex of huFGFR1c-Fc (50 nM) with rhβ-klotho-HIS (250 nM) was captured by 20 uL Protein A beads and panned against A1 and 1AJJ libraries. Three rounds of panning were conducted with a constant target concentration of 50 nM for some lineages, and certain lineages employed a five-fold decease in target concentration (e.g., 50 nM for Round 1, 10 nM for Round 2 and 2 nM for Round 3) each round.

3. Blocking

A. Blocking Plates: Coating solution was removed and wells were washed one time with 200 μL/well of TBS[pH 7.5]/2 mM $CaCl_2$. 250 μl/well of 1% BSA (protease-free) in TBS[pH 7.5]/2 mM $CaCl_2$ was added and incubated for 1 hr. at room temperature with shaking. Alternative reagents (e.g., casein or milk) can be used for blocking.

B. Blocking Beads: Coating solution was removed and beads were washed twice with TBS [pH 7.5]/2 mM $CaCl_2$. 500 μl 1% BSA (protease-free) was added in TBS[pH 7.5]/2 mM $CaCl_2$ and rotated for 1 hr at room temperature. As noted above, alternative blocking reagents can be used.

4. Washes

A. Wash Plates: Wells were washed three times with 200 μL/well of TBS[pH 7.5]/2 mM $CaCl_2$ to remove excess target/blocker.

B. Wash Beads: Beads were washed three times with 1000 μL of TBS[pH 7.5]/2 mM $CaCl_2$ to remove excess target/blocker. Beads were allowed to collect on a magnet for a few minutes after each wash to avoid bead loss.

5. Phage Addition

A. Phage addition to Plates: About 100-1000 library equivalents (A1 domain-based libraries or others, such as LNR, DSL, etc. phage libraries) were added in phage addition buffer (1% nonfat dry milk/0.2% BSA (protease-free), or other appropriate blocking agent, in TBS [pH 7.5]/2 mM $CaCl_2$) and incubated at room temperature for 1-2 hr with shaking. In rounds 2-3, 25-60 μL total of harvested phage was added to each of 5-6 wells (+1 negative control) diluted in phage addition buffer.

B. Phage addition to Beads: About 100-1000 library equivalents (A1 domain-based libraries or others, such as LNR, DSL, etc. phage libraries) were added in 500 μl 1% non-fat dry milk+100 μl 1% BSA (protease-free) in TBS [pH 7.5]/2 mM $CaCl_2$ and incubated with rotation at room temperature for 1-2 hr. In rounds 2-3, 100 μL total of harvested phage were added to beads.

6. Washes

A. Washing Plates: The plates were washed 5 to 7 times with 200 μl/well of TBS [pH 7.5]/2 mM $CaCl_2$/0.1% Tween-20.

B. Washing Beads: The beads were washed 8-12 times with 800 μl of TBS [pH 7.5]/2 mM $CaCl_2$/0.1% Tween-20. Bead resuspension was facilitated by dispensing wash buffer directly onto collected beads or by pipetting up and down. Alternatively, a KingFisher apparatus (Thermo Lab-Systems), or equivalent, is used for bead washing.

7. Phage Elution

A. Elution off of Plates: 100 μL/well of low pH buffer [0.2 M glycine pH 2.0] was added, and the plates were incubated at room temperature for 10 min with shaking. Then, 100 μl of 1M Tris pH 7.5 was added to each well to neutralizing the solution.

B. Elution off of Beads: 100 μL 0.2 M glycine pH 2.0 was added to beads, which were then incubated at room temperature (in an Eppendorf rack) for 10 min with shaking. Then, 400 μl of 1M Tris pH 7.5 was added to each well to neutralizing the solution.

C. Elution and concomitant infection: Phage were eluted by 0.2 M glycine pH 2.0 as above and then remaining phage were recovered using 200-500 μL of log-phase BlueKan K91 *E. coli* cells at $OD_{600}$~0.5-0.8. Cells were added to each well (for plates) or to aspirated beads. The infection was allowed to proceed for 30 min at 37° C. without shaking. Next, the 200 μL volumes were pooled and added to ~3-5 mL of 2×YT/0.2 μg/mL tetracycline and shaken for 15 min at 37° C.

8. Infection: (Same for Plate and Bead Protocol)

An appropriate volume of log-phase BlueKan K91 *E. coli* (in 2×YT/40 μg/mL kanamycin) was grown to $OD_{600}$~0.5-0.8. When the culture reached this $OD_{600}$, it was either used immediately or placed on ice prior to use, although the time on ice was generally minimized A. In a 50 mL sterile conical tube, eluted phage were mixed with 3 mL log-phase BlueKan K91 *E. coli* culture and incubated at 37° C. for 25 min without shaking. The sterile conical tubes were covered with AirPore tape (Qiagen) to facilitate aeration.

B. Tetracycline was added to a final concentration of 0.2 μg/mL and shaken for 15 min at 37° C.

C. A 10 μL aliquot was sampled for titering and serially diluted 10-fold ($10^{-1}$ to $10^{-6}$) in 2×YT, plated in 8 μL/dilution spots (or 70-90 μL/plate) on 2×YT/20 μg/ml tetracycline plates and incubated overnight at 30° C. or 37° C. These plates yielded single colonies used for subsequent phage target-binding ELISAs.

D. Infected 3 mL cultures were diluted ~10-fold into 50 mL 2×YT/20 μg/mL tetracycline and incubated with shaking at 30° C. overnight to saturation.

9. Titering Input Phage was Used in the Current Round of Panning (Same for Plate and Bead Protocol)

A. 100-fold serial dilutions ($10^{-4}$ to $10^{-10}$) of harvested phage were made in 2×YT.

B. 100 μL/well of a log-phase BlueKan K91 *E. coli* culture at $OD_{600}$ 0.5-0.6 was added to 7 wells of a 96-well polypropylene plate.

C. 10 μL of diluted phage was added to the wells containing 100 μL of BlueKan K91 *E. coli*.

D. Phage/cell mixtures were incubated at 37° C. for 25 min without shaking, and the plates were covered with AirPore tape (Qiagen) to allow for aeration.

E. Tetracycline was added to a final concentration of 0.2 μg/mL and the plate was shaken for 15 min at 37° C.

F. 8 μL of each dilution ($10^{-4}$ to $10^{-10}$) was plated onto a dry 2×YT agar/20 μg/mL tetracycline plate.

G. Plates were incubated at 30° C. or 37° C. overnight.

10. Harvesting Phage (Same for Plate and Bead Protocols)

A. Overnight cultures were centrifuged at 6500 or 6800 rpm in disposable 50 mL tubes for 15 min to pellet cells.

B. A standard PEG/NaCl phage-precipitation procedure was performed by adding 1/5 volume of a 20% PEG/15% NaCl stock to culture supernatant. It was mixed well by repeatedly inverting and incubating on ice for 45 min to 1 hr.
C. The culture was centrifuged at 6500 or 6800 rpm for 40 min to pellet phage and the supernatant was discarded.
D. The phage pellet was resuspended in 1 mL TBS [pH 7.5]/2 mM CaCl$_2$, transferred to an Eppendorf tube and centrifuged at 13K rpm for at least 2 min to pellet insoluble material.
E. Supernatant was transferred to a fresh tube and 1/5 volume of PEG/NaCl was added, mixed and incubated on ice for ~5-20 min.
F. The mixture was then centrifuged at 13,000 rpm for at least 2 min, and the supernatant was removed. The pelleted, purified phage were resuspended in approximately 1 mL TBS [pH 7.5]/2 mM CaCl$_2$ and stored at 4° C.

Monomers identified as binding to FGFR1c are shown in FIG. 10, and monomers identified as binding to β-Klotho are shown in FIG. 11.

II. Round 2 and Round 3 Panning

In general, the 2$^{nd}$ and 3$^{rd}$ round panning conditions were the same as in Round 1 described above, except the coated targets were either held at the starting concentration (e.g., 50 nM), or the target concentration was decreased approximately 2- to 5-fold for each subsequent round, and the plates (or beads) were washed approximately 2-4 additional times in each subsequent round of panning.

III. Optimization of Anti-FGFR1c Monomers Through Mutagenesis and Phage Display Panning Mutagenesis libraries were constructed based upon anti-FGFR1c monomers M03, M23 and M33 whose respective sequences (SEQ ID NOS 287, 290 and 292, respectively, in order of appearance) are as follows:

TABLE 3

| | | |
|---|---|---|
| M03 | CGAGLFTCRSTKICISQAWVCDGVDDCEDNSDEKNCSAPASEPPGSL | SEQ ID NO: 287 |
| M23 | CGSNQFTCRSTNICISQAWVCDGVDDCEDDSDETGCSQDPEFHKV | SEQ ID NO: 290 |
| M33 | CRLNEFPCGSGSCISLHWVCDSVPDCRDDSDETDCPERT | SEQ ID NO: 292 |

The primers used for mutagenesis libraries are listed in the following table (SEQ ID NOS 451-460, respectively, in order of appearance) where a common 5'-rescue primer was designed for all libraries along with a 3'-rescue primer unique for each library. Capital letters represent fixed bases, while the lower-case letters represent mixes of bases in a proportion of 0.85:0.05:0.05:0.05 (e.g., 'a' indicates a mix of 0.85A, 0.05T, 0.05G, and 0.05C).

TABLE 4

FGFR1c monomer mutagenesis primers

| | |
|---|---|
| Mut_Lib_5'-Rescue | TTATGCCCCGGGTCTGGAGGCGTCTGGTGGTTCGTG (SEQ ID NO: 451) |
| FGFR1c_M03_3'-Rescue | AAAAGGGCCCCAGAGGCCTTCTGCAATGACAGGGAACCCGGCGGTTC (SEQ ID NO: 452) |
| FGFR1c_M03_Mut_For | GAGGCGTCTGGTGGTTCGTGTgggcgggcctgTTCacgTGCcgcagtaccaaaataTGCatttcacaggcctgggttTGCGACGGC (SEQ ID NO: 453) |
| FGFR1c_M03_Mut_Rev | ACAGGGAACCCGGCGGTTCAGATGCTGGCGCGCTACAgttttttTTCATCCGAgttGTCctcACAATCatcaacGCCGTCGCA (SEQ ID NO: 454) |

TABLE 4-continued

FGFR1c monomer mutagenesis primers

| | |
|---|---|
| FGFR1c_M23_3'-Rescue | AAAAGGGCCCCAGAGGCCTTCTGCAATGACACTTTGTGAAATTC (SEQ ID NO: 455) |
| FGFR1c_M23_Mut_For | GAGGCGTCTGGTGGTTCGTGTgggtcgaaccagTTCacgTGCcggagtaccaacataTGCatttcacaggcctgggttTGCGACGGC (SEQ ID NO: 456) |
| FGFR1c_M23_Mut_Rev | CAATGACACTTTGTGAAATTCCGGATCCTGGCTACAgcctgtTTCATCCGAgtcGTCctcACAATCatcaacGCCGTCGCA (SEQ ID NO: 457) |
| FGFR1c_M33_3'-Rescue | AAAAGGGCCCCAGAGGCCTTCTGCAATGACGTACGCTCTGGAC (SEQ ID NO: 458) |
| FGFR1c_M33_Mut_For | GAGGCGTCTGGTGGTTCGTGtcggctgaacgagTTCccgTGTggcagcggcagcTGCatttcactgcactgggttTGCGACAGC (SEQ ID NO: 459) |
| FGFR1c_M33_Mut_Rev | CAATGACGTACGCTCTGGACAgtctgtTTCATCCGAgtcGTCccgACAATCcggaacGCTGTCGCA (SEQ ID NO: 460) |

Mutagenesis libraries were constructed as follows. The 'FOR' and 'REV' mutagenic oligonucleotides for each monomer were annealed via a 9-base pair overlap (TGCGACGGC) (SEQ ID NO: 461) at 30-31° C. and extended to create double-strand DNA by PCR extension using LA Taq polymerase (Takara). The assembled library inserts were amplified by a pair of 5'/3' "rescue" primers, purified by columns (Qiagen), and digested by SfiI and XmaI (NEB). The digested library inserts were gel-purified and ligated into SfiI/XmaI-digested fUSE5HA vector. The ligated fUSE5HA vector was purified by ethanol or isopropanol precipitation, and was electroporated into EC100 electrocompetent cells (Epicentre Technologies). The electroporated cells were grown overnight and phage was harvested for use in panning.

The panning protocol was essentially as described above but with changes. huFGFR1c was coated onto plates or Protein A beads at 2 or 20 nM (Round 1); 0.1, 0.5 or 5 nM (Round 2); 0.02, 0.1 or 1 nM (Round 3). After phage incubation with target, plates or beads were washed 7×, 9×, or 13×. Some pannings had 11× washes at 37° C., or pannings were in the presence of 10× or 500× molar excess of purified parental monomer binding protein.

IV. Optimization of Anti-rhβ-Klotho Monomers Through Mutagenesis and Phage Panning Mutagenesis libraries were constructed based upon anti-rhβ-klotho monomers M01, M25, M42, and M50 whose respective sequences (SEQ ID NOS 462-463 and 305-306, respectively, in order of appearance) were as follows:

TABLE 5

| | |
|---|---|
| CLPDEFQCGSGRCIPQTWVCDGLNDCGDGSDESPAHCSQDPEFHKVSL | SEQ ID NO: 462 |
| CRSSQFQCNNGHCLSPTWVCDGYDDCEDGSDEANCPTHTSL | SEQ ID NO: 463 |
| CQPDEFTCSSGRCIPQPWLCDGLNDCGDGSDEPPAHCSAPASEPPGSL | SEQ ID NO: 305 |
| CHSFNQFECRNGQCIPLHLVCDGVPDCGDNSDETDCGDSHILPFSTPGPST | SEQ ID NO: 306 |

Construction was essentially the same as described for FGFR1c mutagenesis libraries. The primer sequences are shown in the following table (SEQ ID NOS 466-478, respectively, in order of appearance) where the capital letters represent fixed bases, while the lower-case letters represent mixes of bases in a proportion of 0.91:0.03:0.03:0.03 (e.g., "a" indicates a mix of 0.91A, 0.03T, 0.03G, and 0.03C).

TABLE 6

| Sequences | |
|---|---|
| GGATTATGCCCCGGGTCTGGAGGCGTCTGGTGGTTCGTG | SEQ ID NO: 466 |
| TGCTCGAGGGCCCCAGAGGCCTTCTGCAATGACACTTTG TGAAATTCCGGATCCTGGCTAC | SEQ ID NO: 467 |
| GCTCGAGGGCCCCAGAGGCCTTCTGCAATGACGTATGCG TTGGAC | SEQ ID NO: 468 |
| CTCGAGGGCCCCAGAGGCCTTCTGCAATGACAGGGAACC CGGCGGTTCAGATGCTGGCGCGCTAC | SEQ ID NO: 469 |
| CTCGAGGGCCCCAGAGGCCTTCTGCAATGACGTGCTCGG ACCTGGGGTGCTAAACGGCAGAATATGAGAATCACCAC | SEQ ID NO: 470 |
| GAGGCGTCTGGTGGTTCGTGTctgccggacgagTTCcag TGCgggtcgggacggTGCattccacagacgtgggttTGC GACGGC | SEQ ID NO: 471 |
| GTGAAATTCCGGATCCTGGCTACAgtgtgccggcgaTTC ATCCGAtccGTCcccACAATCatttagGCCGTCGCA | SEQ ID NO: 472 |
| GAGGCGTCTGGTGGTTCGTGTcggtcgagccagTTCcag TGCaacaacgggcacTGCcttttcgccgacctgggttTGC GACGGC | SEQ ID NO: 473 |
| CTGCAATGACGTATGCGTTGGACAgtttgcTTCATCCGA cccGTCctcACAATCatcataGCCGTCGCA | SEQ ID NO: 474 |
| GAGGCGTCTGGTGGTTCGTGTcagccggacgagTTCacg TGCagctcggggcggTGCattccacagccctggcttTGC GACGGC | SEQ ID NO: 475 |

TABLE 6-continued

| Sequences | |
|---|---|
| GTTCAGATGCTGGCGCGCTACAgtgtgccggcggTTCAT CCGAtccGTCcccACAATCattaagGCCGTCGCA | SEQ ID NO: 476 |
| GAGGCGTCTGGTGGTTCGTGTcactcgttcaaccaaTTT gaaTGCcggaacgggcaaTGCattccactgcacctggtt TGCGACGGC | SEQ ID NO: 477 |
| ACGGCAGAATATGAGAATCACCACAgtctgtTTCATCCG AgttGTCcccACAATCcggaacGCCGTCGCA | SEQ ID NO: 478 |

The "FOR" and "REV" oligonucleotides for each monomer were used to construct each library, as described for FGFR1c mutagenesis libraries.

Panning protocol was essentially as described above but with the following changes: rhβ-klotho and recombinant murine beta-klotho (muβ-klotho) were coated at 2 nM and 10 nM (Round 1); 3.3 nM and 0.67 nM (Round 2 and 3). In certain lineages, the target was rhβ-klotho in Rounds 1-3; rmuβ-klotho in Rounds 1-3; rhβ-klotho (Round 1), rmuβ-klotho (Round 2), then rhβ-klotho (Round 3). The number of washes was 7, 9 and 11 times, respectively, for Round 1, 2 and 3.

FIG. 13 shows the sequences of β-Klotho-binding monomers generated using this method.

V. Optimization of Anti-rhβ-Klotho Monomers Through Domain Walking to Create Dimers Two sets of "walked dimer" libraries were constructed. Set 1 contained seed monomers M01, M02, M08, M21 and M42 (SEQ ID NOS 304, 480, 694, 481 and 305, respectively, in the following table; the 'spike monomers' which induce increased signal above total initial signal in AlphaScreen assays), and Set 2 contained seed monomers M06, M46 and M50 (SEQ ID NOS 483-484 and 306, respectively, in the following table; 'non-spike' monomers which do not vary the signal from total initial signal in AlphaScreen assays). The amino acid sequences of these monomers are as follows:

TABLE 7

| | |
|---|---|
| M01 CLPDEFQCGSGRCIPQTWVCDGENDCGDGSDESPAHCSQDPEFHKV | SEQ ID NO: 304 |
| M02 CAANEFRCSNGRCIPEPWLCDGLNDCGDGSDEPPHCAPPT | SEQ ID NO: 480 |
| M08 CPSNQFPCRSTGICIPLAWVCDGLNDCGDGSDESPATCKAPVPT | SEQ ID NO: 512 |
| M21 CQSNEFRCRSGRCIPQHWLCDGLNDCGDGSDESQQCSAPASEPPGSL | SEQ ID NO: 481 |
| M42 CQPDEFTCSSGRCIPQPWLCDGLNDCGDGSDEPPAHCSAPASEPPGSL | SEQ ID NO: 305 |
| M06 CPPSQFTCGNGRCVSLGWVCDGLNDCGDGSDESPALCSAPASEPPGSL | SEQ ID NO: 483 |
| M46 CAPSQFQCHDNNICLLEGLLCDGEDDCADGSDEAPVCGDSHILPFSTPGPST | SEQ ID NO: 484 |
| M50 CHSFNQFECRNGQCIPLHLVCDGVPDCGDNSDETDCGDSHILPFSTPGPST | SEQ ID NO: 306 |

Each set of monomers was fused to a naïve binding protein library (e.g., A1 domain library) at either N-terminus or C-terminus to construct "walked/walking libraries", which are dimer libraries comprised of either the Set 1 or Set 2 monomers fused to a naïve A1 domain library. These libraries were constructed in the following manner. PCR was used to amplify in two separate reactions: a) the coding sequences of the selected monomers with pETF (ACCCGTATGATGTTC-CGGATTA; (SEQ ID NO: 486)/pETB2r (GATGTATTCG-GCCCCAGA GGCCTGCAATGAC; SEQ ID NO: 487); and b) the coding sequences of naïve monomers in a monomer library with 21new1 (GAAATTCACCTCGAAAGCAA; (SEQ ID NO: 488)/23(ATGGGTTCCTATTGGGCT; SEQ ID NO: 489). The ~200 bp products were isolated from a 2-3% agarose gel and purified with Qiagen QIAquick spin columns. Each product from (a) and (b) above was digested with either BsrDI or BpmI (NEB) in separate reactions. BpmI-digested monomers have an overhang which can be ligated to BsrDI-digested monomers. The purified digestion products were ligated to one another using T4 DNA ligase (NEB). Ligation of BsrDI-cut naïve monomers with BpmI-cut selected monomers generates a walking dimer library comprised of N-terminal naïve monomers fused to C-terminal selected monomers (from Set 1 or 2). Ligation of BpmI-cut naïve monomers with BsrDI-cut selected monomers generates a walking dimer library comprised of C-terminal naïve monomers fused to N-terminal selected monomers (from Set 1 or 2). Primers pETF/pETB2r were used to PCR-amplify the ligated dimer from the ligation, and the purified products were digested with SfiI followed by XmaI. The digested products were ligated to the phage vector fUSE5HA for the generation of a phage-displayed dimer "walked/walking library", typically with $10^8$-$10^9$ unique members.

The panning protocol was essentially as described above but with changes. rhβ-klotho was coated at 10 nM and 2 nM (Round 1); 3.3 nM and 0.67 nM (Round 2); 1.1 nM and 0.22 nM (Round 3). The number of washes was 7, 9 and 11 times, respectively, for Round 1, 2 and 3.

FIG. 14 show the sequences of 13-Klotho-binding multimers generated using the walked dimer method.

VI. Analysis of Panning Output (Same for Plate and Bead Protocols)

Phage ELISAs: For each output "phage pool" to be analyzed (typically Rounds 2, 3 and 4, if applicable), independent clones were inoculated into 1 mL (2×YT/20 μg/mL tetracycline) cultures grown in Costar 96-well polypropylene deep-well plates. Inoculating tips were left in, and plates were shaken overnight at 37° C. Cells were pelleted by centrifugation at 3600 rpm for 15 min. Culture supernatants were retained and ELISAs were performed as described below.

Target proteins (hFGFR1c or hβKlotho) diluted to 20 nM in TBS [pH 7.5]/2 mM $CaCl_2$ were directly coated at 100 μL/well onto 96-well Nunc Maxisorp plates. For each phage clone, a no target well was also coated using 100 uL/well TBS [pH 7.5]/2 mM $CaCl_2$ alone. Plates were incubated O/N at 4'C or 1.5 hrs at room temperature with shaking. Plates were emptied and wells were blocked with 200 μL/well of 1% BSA (fraction V)/TBS [pH 7.5]/2 mM $CaCl_2$ and incubated at RT for 1 hr with shaking. Plates were then washed three times with TBS [pH 7.5]/1 mM $CaCl_2$. Next, 40 μL of each phage supernatant was added to wells in the presence of 60 μL of 0.2% BSA/[pH 7.5]/2 mM $CaCl_2$/0.02% Tween-20. Covered plates were incubated at RT for 1.5 hr with shaking.

Plates were washed three times with TBS [pH 7.5]/1 mM $CaCl_2$/0.02% Tween-20. Next, 100 μL/well of α-M13-HRP monoclonal antibody (Amersham Pharmacia), diluted 1:5000 in TBS [pH 7.5]/2 mM $CaCl_2$+0.02% Tween-20, was added. Plates were incubated at room temperature for 1 hr with shaking. Plates were washed three times with TBS [pH 7.5]/2 mM $CaCl_2$/0.02% Tween-20. 100 μL/well of TMB/$H_2O_2$ mixture (Pierce), diluted 1:1, was added for ELISA development. The reactions were allowed to turn blue until the strongest $OD_{650}$ signals reached ~1.0. The reaction was stopped with 100 μL/well 2N $H_2SO_4$, and positive wells changed in color from blue to yellow. Once the reaction was stopped, it was read at $OD_{450}$ on an ELISA plate reader using SoftMaxPro software.

Phage ELISA-positive phage pools were chosen for subcloning into an expression vector if they had (a) a high frequency of individual phage clones that bound to hFGFR1c or hbKlotho and (b) high sequence diversity among the binding-positive phage clones. Pools meeting these criteria were chosen for protein screening in the process outlined below. To subclone the monomer or multimer sequences from a given phage pool into the expression vector, pEve, approximately $10^8$-$10^{10}$ phage were amplified by 25 cycles of PCR as follows:

PCR Recipe
0.5-1 μL purified phage
5 μL 10× Buffer
8 μL 2.5 mM dNTPs
5 μL 10 uM VS-For primer (SEQ ID NO: 490)
5'-ATCATCTGGCCGGTCCGGCCTACCCGTATGATGTTCCGGA-3';

5 μL 10 uM EveNut primer (SEQ ID NO: 491)
5'-AAAAGGCCCCAGAGGCCTTCTGCAATGAC-3';

26 μL $H_2O$
0.5 μL LA Taq polymerase (1 unit) (Takara)
Cycles: 25×[94° C./10 sec., −45° C./30 sec., −72° C./30 sec.]

PCR products were run on a 2% agarose gel for analysis. The monomer or multimer product (approximately 200 bp) was purified with a QIAquick spin column (Qiagen), digested with Sfi I (NEB), purified again with a QIAquick column and then ligated using T4 DNA Ligase (NEB) to the Sfi I digested vector, pEve. The ligation was transformed into electrocompetent BL21 (DE3) E. coli and plated onto 2×YT plates containing kanamycin at 40 μg/mL. Following overnight growth, approximately 3000-6000 individual clones were inoculated into 2×YT/kanamycin and grown overnight. Positive and negative controls were also included on the plates.

VII. Screening of Thousands of Monomer Proteins in 1 mL Cell Lysates

Protein Production of 1 mL heated lysates (Day 1): Individual clones were inoculated into wells of a 96-well Costar deep-well plate containing 500 μL/well of 2×YT/40 μg/mL kanamycin. Cultures were grown overnight (inoculating tips were left in wells) while shaken at 300 rpm at 37° C. This process allowed screening of thousands of individual, partially-purified monomers at the cell-lysate level.

(Day 2) 100 μL of overnight culture was inoculated into new 96-well Costar deep-well plate containing 1 mL/well of 2×YT/40 μg/mL kanamycin+1 mM $CaCl_2$. (The remaining overnight culture was archived by the addition of 25% final glycerol concentration and then stored at −80° C. for later use.) Plates were covered with AirPore Tape (Qiagen) and cultures were grown with shaking at 300 rpm at 37° C. until an $OD_{600}$ of ~0.8 to 1.0 was reached. Once the desired $OD_{600}$ was reached, cultures were induced with 1 mM IPTG for 3 hr while shaking at 375 rpm at 37° C. Plates containing induced cultures were then centrifuged for 15 min at 3600 rpm at 4° C. to pellet cells. Supernatant was removed and discarded, and the remaining cell pellet was resuspended in 100 µL of TBS [pH 7.5]/1 mM CaCl$_2$. Resuspended cells were transferred from the 96-well deep-well plate to a 96-well polypropylene PCR plate and heated for 5 min at 65° C. in a PCR machine. Heated/lysed cells were then centrifuged for 15 min at 3600 rpm at 4° C. After centrifugation, protein production was complete, and protein lysates were ready for characterization in a primary screen via binding ELISA and/or competition AlphaScreen assays.

FGFR1c and β-Klotho Protein ELISA: 96-well Maxisorp plates were coated with 100 µL/well of 20 nM huFGFR1c/Fc or 20 nM huβKlotho-His diluted in TBS[pH 7.5]/1 mM CaCl$_2$, and the covered plate was incubated at 4° C. overnight or room temperature (RT) for 1.5 hr with shaking. For binding proteins comprising an antihuIgG monomer domain, huFGFR1c-His was coated instead of huFGF-Fc. Wells were emptied and then blocked with 200 µL/well of 1% BSA (fraction V)/TBS[pH7.5]/1 mM CaCl$_2$. The covered plate was incubated at RT for 1 hr with shaking. The plate was washed three times with TBS [pH 7.5]/1 mM CaCl$_2$. Protein from 1 mL lysate preparations was added to the wells as a single point concentration diluted 1:10 in TBS [pH 7.5]/1 mM CaCl$_2$/0.1% BSA/0.02% Tween-20 to a final volume of 100 µL per well. For Ni/Q-purified proteins, a titration curve starting at 1-3 µM and diluting serially in TBS [pH 7.5]/1 mM CaCl$_2$/0.1% BSA/0.02% Tween-20 1:3 for monomers or 1:4 for mutant monomers or walked dimers for 12 pts., last point no protein, was added at 100 µL/well to the plate. Covered plates were incubated at RT for 1.5 hr with shaking. The plate was washed three times with TBS [pH 7.5]/1 mM CaCl$_2$/0.02% Tween-20. 100 µL/well of anti-HA-HRP detection antibody (Roche/12013819001) diluted 1:2000 in TBS [pH 7.5]/1 mM CaCl$_2$/0.1% BSA/0.02% Tween-20 was added. Covered plates were incubated at RT for 1 hr with shaking. The plate was washed three times with TBS [pH 7.5]/1 mM CaCl$_2$/0.02% Tween-20. 100 µL well of TMB/H$_2$SO$_4$ mixture diluted 1:1 was added. Color was allowed to turn blue until OD$_{650}$ of the strongest signals reached ~1.0. The reaction was stopped with 100 µL/well of 2N H$_2$SO$_4$. Once stopped, the plate was read on ELISA plate reader at OD$_{450}$ using SoftMaxPro software.

Figure 17:
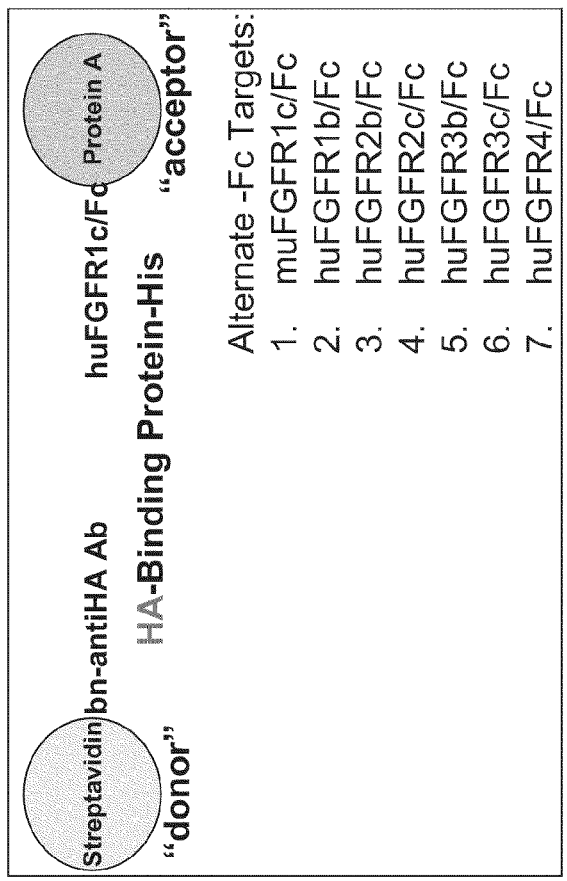
FIG. 17 is a schematic depicting a receptor-Fc protein AlphaScreen binding assay.

Receptor-Fc Protein AlphaScreen Binding Assay: All assay components were diluted in AlphaScreen Buffer: 40 mM HEPES [pH 7.4] w/NaOH, 1 mM CaCl$_2$, 0.1% BSA (w/v), 0.05% Tween-20, 100 mM NaCl. Three additions were made to a white, 384-well, reduced-volume, Greiner microtiter assay plate with no incubation time in between additions. The assay final volume was 6 µL. First, 2 µL of a 1:50 dilution of protein from 1 mL lysate preparations was added to the plate (1:150 final assay dilution.) For Ni/Q-purified protein, 2 µL/well of a titration curve starting at 1 µM final and diluting 1:3 for 12 pts., last point no protein, was added to the plate. Secondly, 2 µL/well of hFGFR1c/Fc at 9 nM (3 nM final assay concentration) was added to the plate. Alternatively, 2 µL/well of family member target-Fc at 9 nM (3 nM final assay concentration) was added to the plate. For monomer mutagenesis, target-Fc concentrations were dropped 6x, to 0.5 nM final assay concentration. Note that the remainder of the assay was done in subdued or green-filtered light as AlphaScreen beads are light sensitive. Thirdly, 2 µL/well of a mixture of biotin-rat-antiHA Ab (clone 3F10, Roche/12 158 167 001) at 3 nM (1 nM final concentration) and AlphaScreen Streptavidin "donor beads" and Protein A "acceptor beads" (PerkinElmer/6760617M) both diluted to 40 µg/mL (10 µg/mL final assay concentration) was added to the plate, as shown in FIG. 17. The assay plate was then covered with topseal and spun down for ~1 min. at 800 rpm. The plate was then incubated overnight in the dark at room temperature and read the next day on the Fusion Plate reader (PerkinElmer).

Figure 18:
FIG. 18 is a schematic depicting a biotinylated-target protein AlphaScreen binding assay.

Biotin-Target Protein AlphaScreen Binding Assay: All assay components were diluted in AlphaScreen Buffer: 40 mM HEPES [pH 7.4] w/NaOH, 1 mM CaCl$_2$, 0.1% BSA (w/v), 0.05% Tween-20, 100 mM NaCl. Three additions were made to a white, 384-well, reduced-volume, Greiner microtiter assay plate with no incubation time in between additions. The assay final volume was 6 µL. First, 2 µL of a 1:50 dilution of protein from 1 mL lysate preparations was added to the plate (1:150 final assay dilution.) For Ni/Q-purified protein, 2 uL/well of a titration curve starting at 1 uM final and diluting 1:3 for 12 pts., last point no protein, was added to the plate. Secondly, 2 µL/well of biotin-bKlotho-His at 15 nM (5 nM final assay concentration) was added to the plate. Alternatively, 2 µL/well of family member target-biotin at 15 nM (5 nM final assay concentration) was added to the plate. The remainder of the assay was done in subdued or green-filtered light as AlphaScreen beads are light sensitive. Thirdly, 2 µL/well of a mixture of rat-antiHA Ab (clone 3F10, Roche/11 867 431 001) at 6 nM (2 nM final concentration) and AlphaScreen Streptavidin "donor beads" and antimuIgG "acceptor beads" (PerkinElmer/6760606M) both diluted to 40 µg/mL (10 µg/mL final assay concentration) was added to the plate, as shown in FIG. 18. The assay plate was then covered with topseal and spun down for ~1 min. at 800 rpm. The plate was then incubated overnight in the dark at room temperature and read the next day on the Fusion Plate reader (PerkinElmer).

Figure 19:
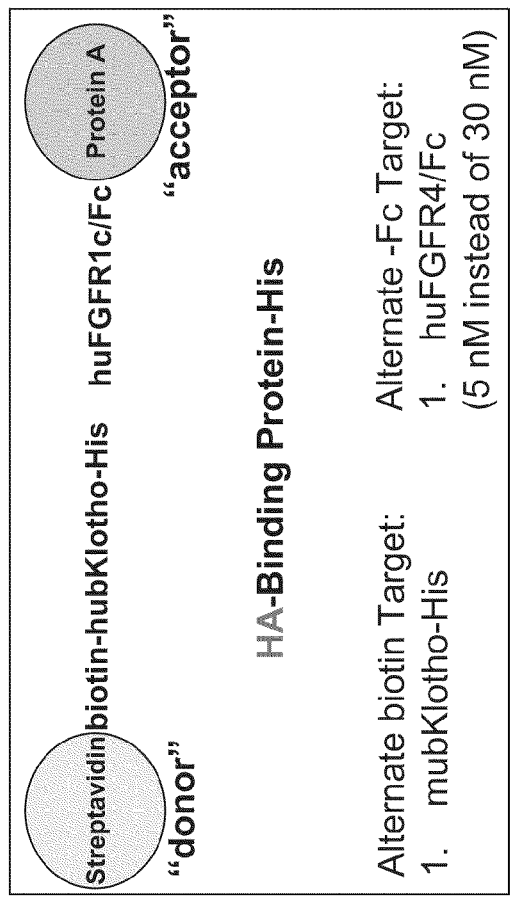
FIG. 19 is a schematic depicting an AlphaScreen ligand-independent inhibition assay.

AlphaScreen Ligand Independent Inhibition Assay: All assay components were diluted in AlphaScreen Buffer: 40 mM HEPES [pH 7.4] w/NaOH, 1 mM CaCl$_2$, 0.1% BSA (w/v), 0.05% Tween-20, 100 mM NaCl. Three additions were made to a white, 384-well, reduced-volume, Greiner microtiter assay plate with no incubation time in between additions. The assay final volume was 6 µL. First, 2 µL of a 1:5 dilution of protein from 1 mL lysate preparations was added to the plate (1:15 final assay dilution.) For Ni/Q-purified protein, 2 µL/well of a titration curve starting at 1 uM final and diluting 1:3 for 12 pts., last point no protein, was added to the plate. Secondly, 2 µL/well of biotin-βKlotho-His at 15 nM (5 nM final assay concentration) was added to the plate. Note that the remainder of the assay was done in subdued or green-filtered light as AlphaScreen beads are light sensitive. Thirdly, 2 µL/well of a mixture of hFGFR1c/Fc at 90 nM (30 nM final concentration) and AlphaScreen Streptavidin "donor beads" and Protein A "acceptor beads" (PerkinElmer/6760617M) both diluted to 40 µg/mL (10 µg/mL final assay concentration) was added to the plate, as shown in FIG. 19. Alternatively, 2 uL/well hFGFR4/Fc at 15 nM (5 nM final concentration) and AlphaScreen (same dilution as above) was added to the plate. The assay plate was then covered with topseal and spun down for ~1 min. at 800 rpm. The plate was then incubated overnight in the dark at room temperature and read the next day on the Fusion Plate reader (PerkinElmer).

Figure 20:
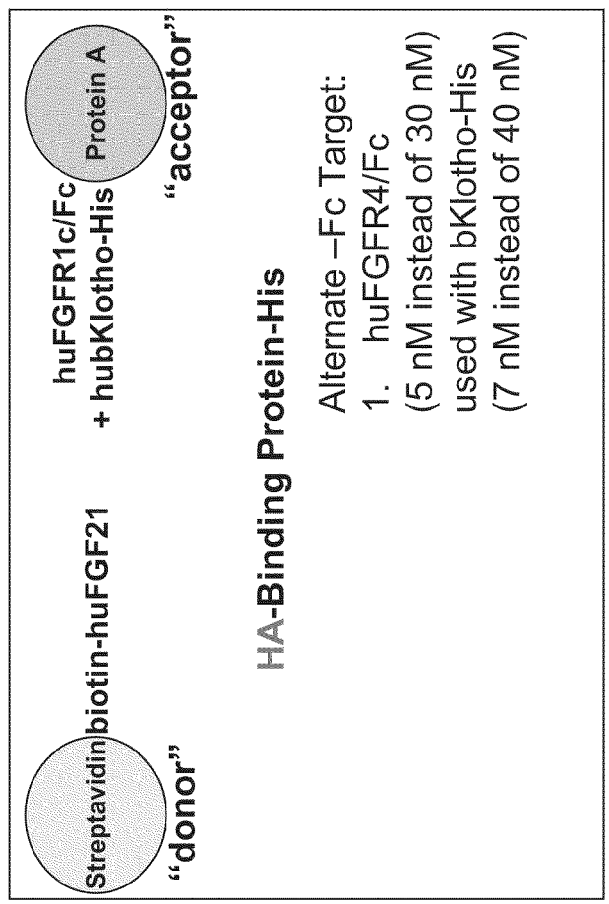
FIG. 20 is a schematic depicting an AlphaScreen ligand-dependent inhibition assay.

AlphaScreen Ligand Dependent Inhibition Assay: All assay components were diluted in AlphaScreen Buffer: 40 mM HEPES [pH 7.4] w/NaOH, 1 mM CaCl$_2$, 0.1% BSA (w/v), 0.05% Tween-20, 100 mM NaCl. Three additions were made to a white, 384-well, reduced-volume, Greiner microtiter assay plate with no incubation time in between additions. The assay final volume was 8 µL. First, 2 µL of undiluted protein from 1 mL lysate preparations was added to the plate (1:4 final assay dilution.) For Ni/Q-purified protein, 2 µL/well of a titration curve starting at 1 uM final and diluting 1:3 for 12 pts., last point no protein, was added to the plate. For a positive control, a titration curve of unlabeled huFGF21 starting at 1 uM final and diluting 1:3 for 12 pts., last point no ligand was added at 2 µL/well to the plate.] Secondly, 4 µL/well of a mixture of hubKlotho-His (or mubKlotho-His) at 80 nM (40 nM final assay concentration) and huFGFR1c/Fc at 60 nM (30 nM final assay concentration) was added to the plate. Alternatively, 4 µL/well of a mixture of hubKlotho-His (or mubKlotho-His) at 14 nM (7 nM final assay concentration) and huFGFR4/Fc at 10 nM (5 nM final assay concentration) was added to the plate. The remainder of the assay was done in subdued or green-filtered light as AlphaScreen beads are light sensitive. Thirdly, 2 µL/well of a mixture of biotin-huFGF21 at 28 nM (7 nM final concentration) and AlphaScreen Streptavidin "donor beads" and Protein A "acceptor beads" (PerkinElmer/6760617M) both diluted to 40 µg/mL (10 µg/mL final assay concentration) was added to the plate, as shown in FIG. 20. The assay plate was then covered with topseal and spun down for ~1 min. at 800 rpm. The plate was then incubated overnight in the dark at room temperature and read the next day on the Fusion Plate reader (PerkinElmer).

Figure 21:
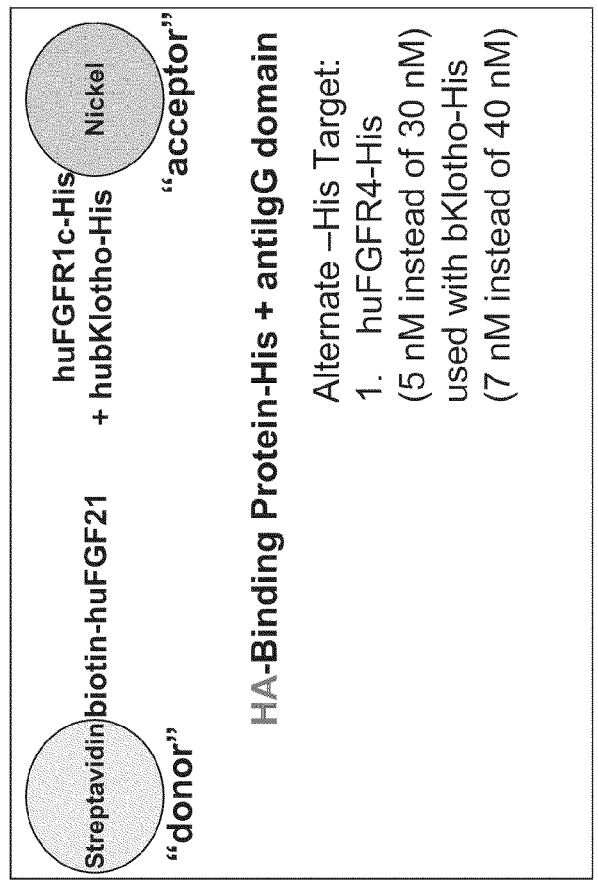
FIG. 21 is a schematic depicting an AlphaScreen ligand-dependent inhibition assay for binding proteins comprising an antihuIgG monomer half life domain.

AlphaScreen Ligand Dependent Inhibition Assay (for binding proteins comprising an antihuIgG monomer half life domain): All assay components were diluted in AlphaScreen Buffer: 40 mM HEPES [pH 7.4] w/NaOH, 1 mM $CaCl_2$, 0.1% BSA (w/v), 0.05% Tween-20, 100 mM NaCl. Three additions were made to a white, 384-well, reduced-volume, Greiner microtiter assay plate with no incubation time in between additions. The assay final volume was 8 µL. First, 2 µL/well of a titration curve of Ni/Q-purified binding protein+IgG monomer domain starting at 1 uM final and diluting 1:3 for 12 pts., last point no protein, was added to the plate. For a positive control, a titration curve of unlabeled huFGF21 starting at 1 µM and diluting 1:3 for 12 pts., last point no ligand was added at 2 µL/well to the plate. Secondly, 4 µL/well of a mixture of hubKlotho-His (or mubKlotho-His) at 80 nM (40 nM final assay concentration) and huFGFR1c-His at 60 nM (30 nM final assay concentration) was added to the plate. Alternatively, 4 µL/well of a mixture of hubKlotho-His (or mubKlotho-His) at 14 nM (7 nM final assay concentration) and huFGFR4-His at 10 nM (5 nM final assay concentration) was added to the plate. The remainder of the assay was done in subdued or green-filtered light as AlphaScreen beads are light sensitive. Thirdly, 2 µL/well of a mixture of biotin-huFGF21 at 28 nM (7 nM final concentration) and AlphaScreen Streptavidin "donor beads" and Nickel Chelate "acceptor beads" (PerkinElmer/6760619M) both diluted to 40 µg/mL (10 µg/mL final assay concentration) was added to the plate, as shown in FIG. 21. The assay plate was then covered with topseal and spun down for ~1 min. at 800 rpm. The plate was then incubated overnight in the dark at room temperature and read the next day on the Fusion Plate reader (PerkinElmer).

VIII. Multimerization and Recombination of Phage Display-Selected Monomers

Monomers that were subcloned into pEve (pEve/monomer) were multimerized in one of the two following ways. pEve/monomer plasmids (individually or in pools) were digested with either BsrDI or BpmI (NEB). The ~1.1 kb BsrDI and ~2.9 BpmI fragments were isolated from 1% agarose gels and purified with Qiagen QIAquick spin columns. Pools of each of the two fragments were ligated using T4 DNA ligase (NEB); subsequently, the ligation was purified with a Qiagen QIAquick spin column. Using the primers VS-For and EveNut described in the phage subcloning section above, the multimer coding sequences were PCR-amplified from the ligation. The PCR products were purified and digested with SfiI (NEB), followed by ligation with pEve and transformation of BL21 (DE3) E. coli. The other method to generate multimers is to amplify the monomers from pEve/monomer plasmids (individually or in pools) with the primers VS-For and EveNut as described above. The amplified monomers were purified, digested with either BsrDI or BpmI (NEB), and ligated to create multimers. The ligated products were amplified with VS-For and EveNut primers, followed by purification, digestion with SfiI, ligation with pEVE vector and transformation into BL21 (DE3) E. coli. The PCR products were purified and digested with SfiI (NEB), followed by ligation with pEve and transformation of BL21 (DE3) E. coli. This method created dimers comprised of different combinations of the starting monomers. This method can also be used to generate other multimers, such as trimers. When making trimers, pools of pEve/dimers and pEve/monomers are the starting materials. They are processed as above. A molecular biology procedure similar to that described below for making "walking libraries" was also used to generate multimers. In all cases, proteins were expressed, purified and screened as above.

Additional libraries, referred to as "walking libraries," were generated by ligating phage display-selected monomers (i.e., selected monomers) with the full representation of a naïve monomer library. These libraries were constructed in the following manner. PCR was used to amplify in two separate reactions: a) the coding sequences of the selected monomers with pETF (ACCCGTATGATGTTCCGGATTA; SEQ ID NO: 486)/pETB2r (GATGTATTCGGCCCCAGA GGC-CTGCAATGAC; SEQ ID NO: 487); and b) the coding sequences of naïve monomers in a monomer library with 21new1 (GAAATTCACCTCGAAAGCAA; SEQ ID NO: 488)/23 (ATGGGTTCCTATTGGGCT; SEQ ID NO: 489). The ~200 bp products were isolated from a 3% agarose gel and purified with Qiagen QIAquick spin columns. Each product from (a) and (b) above was digested with either BsrDI or BpmI (NEB) in separate reactions. BpmI-digested monomers have an overhang which can be ligated to BsrDI-digested monomers. The purified digestion products were ligated to one another using T4 DNA ligase (NEB). Ligation of BsrDI-cut naïve monomers with BpmI-cut selected monomers generates a walking dimer library comprised of N-terminal naïve monomers fused to C-terminal selected monomers. Ligation of BpmI-cut naïve monomers with BsrDI-cut selected monomers generates a walking dimer library comprised of C-terminal naïve monomers fused to N-terminal selected monomers. Primers pETF/pETB2r were used to PCR-amplify the ligated dimer coding sequences from the ligation, and the purified products were digested with SfiI followed by XmaI. The digested products were ligated to the phage vector fUSE5HA for the generation of a phage display dimer "walking library", typically with $10^8$-$10^9$ unique members. A trimer (or larger multimer) "walking library" can be generated in a similar fashion, except that the starting materials are dimers (or larger) and naïve monomers. Walking libraries were panned against β-Klotho and screened as described above.

IX. Characterization of Purified Monomers in Binding and Competition Assays

Once proteins were characterized at the heated protein lysate level, the best monomers were chosen for further characterization. Larger-scale cultures of individual clones were prepared and the monomers, which bear an 8× His tag (SEQ ID NO: 492), were purified via Ni-NTA resin. These nickel-purified monomers were assayed in binding ELISAs and the AlphaScreen competition assay. Protein sequence data and biochemical data from characterization of purified monomers are in FIGS. 10-12.

Protein Purification From 500 mL Cultures for NiNTA: (Day 1) In a 15 mL culture tube containing 3 mL of 2×YT+40 μg/mL kanamycin, the appropriate "primary hit well" archived glycerol stock was inoculated. Culture was shaken overnight at 300 rpm at 37° C.

(Day 2) 2 mL of overnight culture was inoculated into 1 L Erlenmeyer shake flask containing 500 mL of 2×YT+40 μg/mL kanamycin. Cultures were grown with shaking at 375 rpm at 37° C. until an $OD_{600}$ of about 0.8-1.0 was reached. Once desired $OD_{600}$ was reached, cultures were induced with 1 mM final concentration of IPTG for 3 hr while shaking at 375 rpm. After 3 hr induction, the 500 mL culture was transferred to clean/autoclaved Sorvall tube and centrifuged for 8 min at 8000 rpm at 4° C. to pellet cells.

Once cells were pelleted, supernatant was removed and discarded, and 20 mL of Nickel Binding/Wash Buffer (20 mM Tris [pH 7.5]/20 mM Imidazole/300 mM NaCl/0.2 mM $CaCl_2$) was added to each tube. The pellet was resuspended with 10 mL serological pipet until there were no visible clumps, and then the resuspended cells (~30 mL) were transferred into 35 mL Oakridge Tubes and heated in a water bath for 10 min at 80° C. to lyse cells. After heating, the warm Oakridge Tubes containing lysed cells were placed in a ice/water bath for ~10 min to cool. Once cooled, tubes were centrifuged for 30 min at 18,000 rpm at 4° C. to pellet cells.

NiNTA resin (Qiagen) was washed with Nickel Binding Buffer 3× before addition to protein lysate in order to equilibrate the resin. A total of 1.5 mL of NiNTA resin in Nickel Binding/Wash Buffer was added to appropriately labeled (with protein ID) clean 50 mL screw cap tube. After lysed cells were pelleted, protein supernatant was removed and added to 50 mL tube containing the 1.5 mL of washed NiNTA resin. Protein was allowed bind to NiNTA resin by rocking gently for 0.5 hours at room temperature. After incubation with NiNTA resin, 50 mL tubes with NiNTA bound to protein was centrifuged for 10 min at ~1500 rpm. Supernatant was gently poured out and discarded.

NiNTA resin+bound protein was transferred to appropriately labeled 15 mL Clontech columns by adding 1 mL of Nickel Binding/Wash Buffer to 50 mL tube containing resin, swirling to resuspend, then pipetting the mixture into a column which has been mounted on a vacuum manifold. NiNTA resin+bound protein was washed with at least 10 column volumes (15 mL) of NiNTA wash buffer. 15 mL columns containing NiNTA resin+bound and washed protein were transferred to a clean 15 mL screw cap collection tubes and 4 mL of Ni Elution buffer (20 mM Tris [pH 7.5], 200 mM NaCl, 0.1 mM $CaCl_2$, 200 mM imidazole) was added to each column to elute off protein into the 15 mL collection tube. It was then allowed to elute by gravity.

Eluted protein was transferred to slide-A-lyzer cassette (appropriate MW cutoff—for monomers used 3.5 kDa cutoff and for dimers and trimers used 10 kDa cutoff) using 18.5 gauge needle and 5 mL syringe to load cassette. Slide-A-lyzer cassettes containing eluted proteins were placed into overnight dialysis buffer containing redox reagents (20 mM Tris [pH 7.5], 100 mM NaCl, 1 mM $CaCl_2$, 1 mM 2-mercaptoethanol, 0.25 mM 2-hydroxyethyldisulfide).

(Day 3) Slide-A-lyzer cassettes containing overnight dialyzed proteins were transferred into dialysis buffer without redox (20 mM Tris [pH 7.5], 50 mM NaCl, 1 mM $CaCl_2$). After 3 hr dialysis, Slide-A-lyzer cassettes were transferred into fresh TBS/$CaCl_2$ without redox for another 3 hr. After $2^{nd}$ dialysis change, proteins were removed from Slide-A-lyzer cassettes using 18.5 gauge needle and 5 mL syringe, and protein was transferred by filtering using 0.2 micron syringe filter into appropriately labeled 15 mL polypropylene tube.

The purified binding proteins, which were selected as the "best agonists" in reporter cell assays, were further purified by Q-Sepharose anion exchange to remove contaminants.

Q-Sepharose Purification: 1 mL of Q-Sepharose Fast-Flow Resin (Amersham Biosciences) was added to 15 mL Clontech column. Resin with 15 column volumes (or 15 mL) of 20 mM Tris [pH 7.5], 50 mM NaCl, 1 mM $CaCl_2$ was equilibrated. 2 mL (~5 mg) of filtered NiNTA-purified protein was added to resin and protein was allowed to bind to resin by gravity. Flow-through into first column of 96-well plate was collected. Columns loaded with protein were transferred to 15 mL collection tube and resin/bound protein were washed with 10 column volumes (or 10 mL) of 20 mM Tris [pH 7.5], 50 mM NaCl, 1 mM $CaCl_2$. Once washed, NaCl gradient elution of protein was started. NaCl concentration was varied in gradient as follows: 100 mM, 150 mM, 180 mM, 200 mM, 220 mM, 250 mM NaCl, to a base of 20 mM Tris [pH 7.5], 1 mM $CaCl_2$. Fractions were collected in 96-well deep-well polypropylene plate-2 mL/fraction, in 1 mL increments. Fractions containing protein were tested by Bradford and analyzed by SDS PAGE. Fractions were tested in binding ELISAs and competition assays as described above with the following change. Protein from 500 mL NiNTA purified preparations or NiNTA+ Q-sepharose purified preparations was added to the plate as a twelve-point concentration curve starting with a 1:5 to 1:100 first dilution and then 1:4 serial dilutions thereafter with the last point as buffer only.

FGFR1c Binding Monomers

The following is a summary of the FGFR1c monomers identified from the panning of the naïve A1 library (SEQ ID NOS 493-508, 288, 290, 511, 292, 513, 291, 515-517, 289, 519-522, 287 and 524-525, respectively, in order of appearance; see FIG. 10):

```
                1                                              50
M01     CASGQFQCSN GN.CVPQHWV CDGDNDCEDN SDEED..CGD SHILPFSTPG

M24     CGSSEFQCRN SRRCIPPAWV CDGDNDCGDS SDEKS..CGD SHILPFSTPG

M39     CVSGQFQCGN GN.CIPRPWR CDGDNDCGDS SDETG..CGD SHILPFSTPG

M36     CVPGQFQCNN GN.CIPVTWL CDGDNDCGDS SDEAP..AHC ETSGPT....

M38     CVSGQFQCGN GN.CIPQAWL CDGDNDCGDS SDEKD..CTT RT........

M04     CRSRQFQCKG SSTCIPVQWV CDGDNDCGDS SDEAG..CSA PASEPPGSL.

M06     CGAGQFQCRS TNICVSLAWR CDGEDDCEDN SDETS..CAT HT........

M09     CGAGQFTCRS TKICISQAWV CDGVDDCEDN SDEAG..CGD SHILPFSTPG

M12     CGAGQFTCRS TNICLPLQWV CDGVDDCEDN SDEAG..CGD SHILPFSTPG

M14     CGANQFTCHN TNICISLTWV CDGVDDCEDN SDEAG..CGD SHILPFSTPG

M26     CGSSQFTCHN TNICLPRARV CDGVDDCEDN SDEAG..CGD SHILPFSTPG

M27     CGSSQFTCHN TNICLPRAWV CDGVDDCEDN SDEAG..CGD SHILPFSTPG

M13     CGANQFTCHN TNICISLTWV CDGVDDCEDG SDESPDHCGR PGPGATSAPA

M19     CGPIQFTCRN TNICLSVHWV CDGEDDCEDG SDEEG..CGR PGPGATSAPA

M20     CGPNQFTCRS TNICLSQTWV CDGVDDCEDG SDETN..CGR PGPGATSAPA

M21     CGPSQFTCRN TNICISLRWR CDGVDDCEDN SDEEG..CGT TGPT......

M08     CGAGQFTCRD TNICISRAWR CDGVDDCEDN SDEAD..CSQ DPEFHKV

M23     CGSNQFTCRS TNICISQAWV CDGVDDCEDD SDETG..CSQ DPEFHKV

M32     CQSNEFQCRS TGRCISVAWV CDGEDDCRDS SDEAD..CSQ DPEFHKV

M33     CRLNEFPCGS .GSCISLHWV CDSVPDCRDD SDETD..CPE RT........

M02     CASGQFTCRS TNICLSLAWL CDGDDDCEDN SDESPAICSA PASEPPGSL.

M31     CLSDQFTCRS TNICLPLQWV CDGDDDCEDN SDEED..CSA PASEPPGSL.

M05     CGAGQFQCRS TNICISLKWV CDGVDDCEDN SDETS..CSA PASEPPGSL.

M07     CGAGQFTCRS TNICISPRWV CDGVNDCEDN SDEKN..CSA PASEPPGSL.

M16     CGARQFPCRG SRICISQPWV CDGDNDCEDN SDEKN..CSA PASEPPGSL.

M15     CGANQFTCHN TNICISQAWV CDGVDDCEDN SDEKN..CSA PASEPPGSL.

M25     CGSSQFTCHN TNICLPQAWV CDGVDDCEDN SDEKN..CSA PASEPPGSL.

M29     CGSSQFTCHN TNICLPRAWV CDGVDDCEDN SDEKN..CSA PASEPPGSL.

M18     CGPGQFTCQD TEICISQAWV CDGVDDCEDN SDEKN..CSA PASEPPGSL.

M11     CGAGQFTCRS TKICISQAWV CDGVDDCEDN SDETS..CSA PASEPPGSL.

M03     CGAGLFTCRS TKICISQAWV CDGVDDCEDN SDEKN..CSA PASEPPGSL.

M10     CGAGQFTCRS TKICISQAWV CDGVDDCEDN SDEKN..CSA PASELPGSL.

M30     CGTGQFTCRS TKICISQAWV CDGVDDCEDN SDEKN..CSA PASEPPGSL.

51
M01     PST

M24     PST

M39     PST

M36     ...

M38     ...

M04     ...

M06     ...
```

```
M09    PST
M12    PST
M14    PST
M26    PST
M27    PST
M13    A..
M19    A..
M20    A..
M21    ...
M08    ...
M23    ...
M32    ...
M33    ...
M02    ...
M31    ...
M05    ...
M07    ...
M16    ...
M15    ...
M25    ...
M29    ...
M18    ...
M11    ...
M03    ...
M10    ...
M30    ...
```

The following is a consensus sequence for the FGFR1c-binding monomers. Conserved residues are in bold. Framework cysteines denoted as C. The range of linkers identified are also listed.

(SEQ ID NO: 74)
C(A/G/L/Q/R/V)(A/L/P/S/T)(D/G/I/N/R/S)(E/L/Q)F
(P/Q/T)C(G/H/K/N/Q/R/S)(D/G/N/S)(G/S/T)(E/G/K/N/R/
S)(I/R/S/T/-)C(I/L/V)(P/S)(L/P/Q/R/V)
(A/H/K/P/Q/R/T)W(L/R/V)CDG(D/E/V)(D/N/P)DC(E/G/R)D
(D/G/N/S)SDE(A/E/K/S/T)(D/G/N/P/S)(A/D/-)(I/H/-)C

Linkers:

```
ATHT,              (SEQ ID NO: 6)
PERT,              (SEQ ID NO: 7)
TTRT               (SEQ ID NO: 8)
```

-continued

```
GTTGPT,            (SEQ ID NO: 9)
ETSGPT             (SEQ ID NO: 10)
SQDPEFHKVS         (SEQ ID NO: 11)
SAPASEPPGSL        (SEQ ID NO: 12)
GRPGPGATSAPAA      (SEQ ID NO: 13)
GDSHILPFSTPGPST    (SEQ ID NO: 14)
```

The following is a summary of the FGFR1c-binding monomers identified from the panning of the M03/M15 mutant monomer library (SEQ ID NOS 293-295, 448, 297, 449-450, 464, 296 and 287, respectively, in order of appearance)

```
            1                                               47
M03mut01    CGAGLFTCRS  TNICISQVWV  CDGVDDCEDN  SDEDSCSAPA  SEPPGSL M03mut04    CGAGLFTCRS  TNICISQAWV  CDGVDDCEDN  SDENYCSAPA  SEPPGSL M03mut05    CGAGLFTCRS  TNICISQAWV  CDGVDDCEDN  SDETNCSAPA  SEPPGSL M03mut07    CGEGLFTCGS  TNICISSAWV  CDGVDDCEDN  SDENNCSAPA  SEPPGSL M03mut09    CGEGLFTCRS  TNICISHAWV  CDGVDDCEDN  SDENNCSAPA  SEPPGSL M03mut08    CGEGLFTCRS  TNICISEAWI  CDGVDDCEDN  SDEKNCSAPA  SEPPGSL M03mut03    CGAGLFTCRS  AKICISHAWV  CDGIDDCEDN  SDENNCSAPA  SEPPGSL M03mut02    CGAGLFTCRN  SKICISQAWV  CDGVDDCDDN  SDEKYCSAPA  SEPPGSL M03mut06    CGASLFTCRR  SNICISQAWV  CDGVDDCEDN  SDEMNCSAPA  SEPPGSL M03ori      CGAGLFTCRS  TKICISQAWV  CDGVDDCEDN  SDEKNCSAPA  SEPPGSL
```

The following is a consensus sequence for the FGFR1c monomers identified from the panning of the M03/M15 mutant monomer library. Conserved residues are in bold. Framework cysteines denoted as C. The range of linkers identified are also listed.

(SEQ ID NO: 108)
C̲G(A/E)(G/S)LFTC(G/R)(N/R/S)(A/S/T)(K/N)ICIS
(E/H/Q/S)(A/V)W(I/V)C̲DG
(I/V)DDC̲(D/E)DNSDE(D/K/M/N/T)(N/S/Y)C̲

(SEQ ID NO: 12)
Linker: SAPASEPPGSL

The following is a summary of the FGFR1c monomers identified from the panning of the M23 mutant monomer library (SEQ ID NOS 298, 479, 303, 301, 299, 482, 485, 302, 300 and 290, respectively, in order of appearance)

```
            1                                          45
M23mut10    CGANLFTCQS  TNICISDAWV  CDGVDDCEDN  SDETTCSQDP  EFHKV M23mut18    CGTNMFTCQR  TNICISDAWV  CDGVDDCEDY  SDETACSQDP  EFHKV M23mut17    CGTNLFTCRS  TNMCISQAWV  CDGVDDCEDN  SDETVCSQDP  EFHKV M23mut15    CGSNLFTCRR  TNICISKAWV  CDGVDDCEDN  SDETGCSQDP  EFHKV M23mut11    CGANLFTCRS  TNICISPAWV  CDGVDDCEDY  SDEIGCSQDP  EFHKV M23mut12    CGANLFTCRS  TNICISPTWV  CDGVDDCDDN  SDEIGCSQDL  EFHKV M23mut13    CGPNLFTCRS  TNICISRAWV  CDGVDDCDDE  SDEQGCSQDP  EFHKV M23mut16    CGSNLFTCRS  TNICISPAWV  CDGVDDCDDD  SDETGCSQDP  EFHKV M23mut14    CGSDMFTCRS  TNICISKVWV  CDGVDDCEDD  SDERGCSQDP  EFHKV M23ori      CGSNQFTCRS  TNICISQAWV  CDGVDDCEDD  SDETGCSQDP  EFHKV
```

The following is a consensus sequence for the FGFR1c monomers identified from the panning of the M23 mutant monomer library. Conserved residues are in bold. Framework cysteines denoted as C. The range of linkers identified are also listed.

(SEQ ID NO: 119)
C̲G(A/P/S/T)(D/N)(L/M/Q)FTC̲(Q/R)(R/S)TN(I/M)
C̲IS(D/K/P/Q/R)(A/T/V)WVC̲DGVDDC̲(D/E)D(D/E/N/Y)
SDE(I/Q/R/T)(A/G/T/V)C̲

(SEQ ID NO: 11)
Linker: SQDPEFHKVS

βKlotho Binding Monomers and Dimers

The following is a summary of the βKlotho monomers identified from the panning of the naïve A1 library (SEQ ID NOS 304, 510, 290, 512, 512, 480, 514, 518, 523, 527-536, 484, 537-541, 483, 483, 542, 481, 305, 543-547, 547-550, 306, 551, 551-562, 1235 and 563, respectively, in order of appearance; see FIG. 11)

```
            1                                                    50
M01     .CLPDEFQCG S.GRCIPQTW VCDGLNDCGD GSDESPAHCS QDPEFHKV..

M15     .CAANEFTCR S.GRCLSRPW LCDGENDCGD GSDE..ADCS QDPEFHKV..

M29     .CGSNQFTCR STNICISQAW VCDGVDDCED DSDET..GCS QDPEFHKV..

M08     .CPSNQFPCR STGICIPLAW VCDGLNDCGD GSDES.PATC KAPVPT....

M13     .CPSNQFPCR STGICIPLAW VCDGLNDCGD GSDES.PATC KAPVPT....

M02     .CAANEFRCS N.GRCIPEPW LCDGLNDCGD GSDEP.PHCA PPT.......

M07     .CPSNEFQCQ NSGRCIPRRW LCDGEDDCGD NSDEA.SCGR PGPGATSAPA

M22     .CQSSEFQCS N.GSCIPRPL VCDGENDCGD SSDET.DCKE PT........

M16     .CRPGEFRCR STNTCISQSL RCDGEPDCRD GSDEP..EDC ESVAHT....

M34     .CRSSEFPCH GYSTCISLSL LCDGVDDCAD NSDE...ESC RAAGHT....

M30     .CHHHHFHCL SG.ECIN.TW RCDGGPDCKD KSDEENCPTK RPEEV.....

M41     .CSRAHFHCL SG.ECIHHHW RCDGGPDCKD KSDEENCPTK RPEEV.....

M37     .CSAFEFHCL SG.ECIHSSW RCDMDWDCKD QPDQLWCALE T.........

M40     .CSAFEFHCL SG.ECIHSSW RCDWYWDCKD YWDPLVCELE A.........

M38     .CSAFEFHCL SG.ECIHSSW RCDWDDDCKD WQDYVMCALE A.........

M39     .CSAFEFHCL SG.ECIHSSW RCDWDLDCKD HPDEVMCALE A.........

M18     .CVPNQFPRG NG.SCIPLPL VCDGVDDCLD DSDEKN..CT PPT.......

M26     .CVPNQFQCG SG.RCLPHPL GCDGVDDCLD GSDEAS..CA PPT.......

M27     .CVSDEFPCR DNNICVLLHL LCDGVDDCLD SSDET..GCA KPT.......

M46     .CAPSQFQCH DNNICLLEGL LCDGEDDCAD GSDEAP.VCG DSHILPFSTP

M57     .CRSSQFPCQ DSNICVLETL LCDGVDDCVD DSDEE..DCG DSHILPFSTP

M17     .CRSNQFRCN SG.HCLPRPW LCDGVDDCQD DSDETD..CP ART.......

M24     .CRPGQFWCN SG.RCLPPAW RCDGVNDCGD DSDEPLALCE KHT.......

M03     .CLPNQFRCG NG.HCLSRTW VCDGVPDCED NSDESLAHCS APASEPPGSL

M04     .CPAGQFQCG NG.QCLSLTW LCDGVPDCGD NSDESSALCS APASEPPGSL

M06     .CPPSQFTCG NG.RCVSLGW VCDGLNDCGD GSDESPALCS APASEPPGSL

M14     .CPPSQFTCG NG.RCVSLGW VCDGLNDCGD GSDESPALCS APASEPPGSL

M45     .CRPNEFPCN NG.RCLSQTW VCDGLNDCGD GSDESPELCS APASEPPGSL

M21     .CQSNEFRCR SG.RCIPQHW LCDGLNDCGD GSDESQ.QCS APASEPPGSL

M42     .CQPDEFTCS SG.RCIPQPW LCDGLNDCGD GSDEPPAHCS APASEPPGSL

M48     .CQPDEFTCR SG.RCIPQPW LCDGLNDCGD GSDEPPGHCT APASEPPGSL

M05     .CPPNQFRCG NG.HCLSVSW LCDGVPDCGD NSDEALAICR ASEHT.....

M09     .CRANEFRCN SG.RCLSQTW VCDGVDDCED GSDESLAICG DSHILPFSTP

M11     .CRANQFTCN NG.HCLSRTW LCDGVPDCED NSDESLAIRG DSHILPFSTP

M23     .CRANQFTCN NG.HCLSRTW LCDGVPDCED NSDESLAICG DSHILPFSTP

M51     .CRANQFTCN NG.HCLSRTW LCDGVPDCED NSDESLAICG DSHILPFSTP

M53     .CLPGQFRCN SG.HCLSQTW VCDGYNDCGD GSDEPLATCG DSHILPFSTP

M19     CKPTNEFRCS NG.HCISRAL LCDGENDCED NSDETS..CG DSHILPFSTP
```

```
M28  .CASSEFQCR STRTCVPLGW VCDGDNDCPD NSDET..DCG DSHILPFSTP

M50  CHSFNQFECR NG.QCIPLHL VCDGVPDCGD NSDETD..CG DSHILPFSTP

M32  CQATAQFQCD NG.HCLSANW RCDGVDDCGD NSDEED..CG DSHILPFSTP

M54  CQATAQFQCD NG.HCLSANW RCDGVDDCGD NSDEED..CG DSHILPFSTP

M43  CKSIAQFECS NG.HCLSRTW LCDGVDDCGD NSDEALATCG DSHILPFSTP

M33  .CRPSEFQCG NG.SCLSATW LCDGVPDCGD GSDESPETCG DSHILPFSTP

M44  .CRPNEFQCG NG.HCLSANW LCDGVDDCGD DSDET..SCG DSHILPFSTP

M20  .CPSSQFQCK NG.HCLSRTW LCDGVDDCQD GSDESPAICT ASGHT.....

M55  .CPSSQFQCK NG.HCLSRTW LCDGVDDCQD GSDESPATCG DSHILPFSTP

M25  .CRSSQFQCN NG.HCLSPTW VCDGYDDCED GSDEAN..CP THT.......

M36  .CRSSEFQCN NG.HCLSATW VCDGYDDCED GSDEAN..CP THT.......

M47  .CPANQFRCN NG.HCLSRTW VCDGYDDCED GSDEAN..CP THT.......

M31  .CPANQFRCN NG.HCLSGTW LCDGVDDCGD NSDESSATCE PHT.......

M12  .CRSSEFQCG NG.HCLSRTW LCDGVNDCGD DSDEKN..CA GAAPT.....

M52  .CLSNQFQCD NG.HCLSLTW RCDGYNDCGD SSDEEN..CA ASEHT.....

M56  .CRSSEFKCK NG.HCLSATW VCDGYVDCGD DSDEED..CA TSGHT.....

51
M01  ....

M15  ....

M29  ....

M08  ....

M13  ....

M02  ....

M07  A...

M22  ....

M16  ....

M34  ....

M30  ....

M41  ....

M37  ....

M40  ....

M38  ....

M39  ....

M18  ....

M26  ....

M27  ....

M46  GPST

M57  GPST

M17  ....

M24  ....

M03  ....
```

| | |
|---|---|
| M04 | .... |
| M06 | .... |
| M14 | .... |
| M45 | .... |
| M21 | .... |
| M42 | .... |
| M48 | .... |
| M05 | .... |
| M09 | GPST |
| M11 | GPST |
| M23 | GPST |
| M51 | GPST |
| M53 | GPST |
| M19 | GPST |
| M28 | GPST |
| M50 | GPST |
| M32 | GPST |
| M54 | GPST |
| M43 | GPST |
| M33 | GPST |
| M44 | GPST |
| M20 | .... |
| M55 | GPST |
| M25 | .... |
| M36 | .... |
| M47 | .... |
| M31 | .... |
| M12 | .... |
| M52 | .... |
| M56 | .... |

The following is a consensus sequence for the β-Klotho-binding monomers. Conserved residues are in bold. Framework cysteines denoted as C. The range of linkers identified are also listed.

(SEQ ID NO: 130)
C(L/A/P/R/V/K/Q/G/H/S)(A/P/S/H/R)(-/T)

(D/N/G/S/H/A/F)(E/H/Q)F(H/P/Q/T/R/W)C (G/S/Q/R/N/L/H/K)(S/N/D)(G/S/T/N/Y)

(R/H/Q/G/H/N/S/E)(R/I/T/-)C(I/L/V)(H/N/P/S)

(A/G/H/L/S/Q/P/R/E/V)(T/P/G/S/R/A/H/N/-)

(W/L)(I/L/R/V)CD(G/M/W)(G/Y/D/V/E/L)

(P/W/L/D/N)DC(G/E/R/Q/L/K)D(G/N/D/S/K/W/H/Y)

(P/Q/S/W)D(E/P/Q/Y)(A/P/S/-)(L/P/Q/S/-)

(A/E/H/K/L/T/V)

(H/I/L/S/T/D/N/G/M/V/W)C

Linkers:

4 amino acids:
(SEQ ID NO: 15)
(A/E/K/P/T)(A/E/K/L/P/T)(E/H/P/R)T

-continued 6 amino acids:
(SEQ ID NO: 16)
(A/E/K/R/T)(A/G/S)(A/P/S/V)(A/E/G/V)(H/P)T 8 amino acids:
(SEQ ID NO: 17)
PTKRPEEV 9 amino acids:
(SEQ ID NO: 18)
SQDPEFHKV 11 amino acids:
(SEQ ID NO: 12)
SAPASEPPGSL 13 amino acids:
(SEQ ID NO: 13)
GRPGPGATSAPAA 15 amino acids:
(SEQ ID NO: 14)
GDSHILPFSTPGPST The following is a summary of the βKlotho monomers identified from the panning of the naïve LNR library (SEQ ID NOS 1243, 1246, 1253, 1251, 1250, 1276, 1247, 1254, 1277, 1255, 1257, 1261, 1258, 1260, 1278, 1244, 1252, 1279, 1245, 1256 and 1262 respectively, in order of appearance, Family 5; see FIG. 12.

The following is a consensus sequence for the β-Klotho-binding monomers identified from the panning of the LNR library. Framework cysteines denoted as C.

(SEQ ID NO: 1280)
C[HNP-][AP-][HIKLMPRV-][AEILY][ADEGQRY][ADEHIKLN
PQS][DHLMSY]C[AEKPQT][AEHKNQRS][FLRY][DFVY]GDG[D
EGIKNRSV]C[DEGHNQRS][EKPQS][ADEGHPQ]C[DGNS][FLNS
T][AEPSY][AEGKRT]C[ADGILNSV]WDG[DFGLMV][DN]C

All monomers derived from LNR library panning against β-Klotho have 9 amino acid long linkers. The following is the consensus sequence for these linkers.

(SEQ ID:NO 1281)
[ADEGPQR][DEHLMPRTV][DEIKNV][AEFLQRSVW][ADGHILNSV]
[ADEGHPQRT]

The following is a summary of the β-Klotho monomers identified from the panning of the mutagenesis library constructed from β-Klotho M01 (SEQ ID NOS 19-21, 526, 465, 509 and 563, respectively, in order of appearance, Family 6; see FIG. 13)

```
            1                                      4
LNR_M01  C..IAAKLCE ALDGDGVCHK ECDLEECDWD GGDCQRIFLT DPT   (SEQ ID NO: 1243)

LNR_M05  C..MAYNLCT ALVGDGECDQ ECDTPTCNWD GGDCAVKSAP DST   (SEQ ID NO: 1246)

LNR_M11  C..MAYNLCQ ALVGDGSCNS ECDTETCGWD GMDCATVEGA EAT   (SEQ ID NO: 1253)

LNR_M09  C..MAYLLCK KYYGDGICRS ECDTATCSWD GFDCPVNEIE DLT   (SEQ ID NO: 1251)

LNR_M08  C..IAAKLCE RLDGDGSCQS ECGNATCGWD GMDCDEKEND ELT   (SEQ ID NO: 1250)

LNR_M04  C..REYISCP NFYGDGRCQQ DCNLAKCVWD GLDCADVWSE DLT   (SEQ ID NO: 1276)

LNR_M06  C..MEAKSCQ ARDGDGDCGQ GCNLAECIWD GMDCRPEWIR ELT   (SEQ ID NO: 1247)

LNR_M12  C..REYSMCT RFDGDGICHE QCGYPRCLWD GLDCANNFDH EVT   (SEQ ID NO: 1254)

LNR_M07  C...LYQDCK EYYGDGNCSK GCNLAECLWD GGDCGTIFLA DVT   (SEQ ID NO: 1277)

LNR_M13  CNPLYDPHCR SYFGDGDCGP GCDLAACLWD GGDCPGVAAA ELT   (SEQ ID NO: 1255)

LNR_M15  CNPLYDDHCA AFFGDGGCGP ECSLAECLWD GGDCEEERDA DVT   (SEQ ID NO: 1257)

LNR_M19  CNPVYDPYCA AFFGDGGCGP HCGLAECVWD GMDCDHKEVR ELT   (SEQ ID NO: 1261)

LNR_M16  CNPKYDAHCA SYFGDGECDP ACSLAECVWD GDDCDPNFLT DVT   (SEQ ID NO: 1258)

LNR_M18  CNPPIGQYCT QLFGDGDCGP DCDLAECVWD GDDCDPVAVP DVT   (SEQ ID NO: 1260)

LNR_M20  CNPPIGQYCT QLFGDGDCGP ECNLAECVWD GDDCDPVAVP ELT   (SEQ ID NO: 1278)

LNR_M02  CPPHIEDHCE RRDGDGVCQK PCDFYGCLWD GVNCDMDLVQ ELT   (SEQ ID NO: 1244)

LNR_M10  CPPHIEDHCE RRDGDGVCQK PCDFYGCLWD GVDCDMDLVE ELT   (SEQ ID NO: 1252)

LNR_M17  CPAHYGTHCE ERDGDGKCHQ GCDFATCDWD GMDCGMDLVR ELT   (SEQ ID NO: 1279)

LNR_M03  CNPIIQHYCE TYDGDGLCES ACNFYGCAWD GFDCQVISDK DST   (SEQ ID NO: 1245)

LNR_M14  CHPLIREYCE KFFGDGGCDS GCNNSRCDWD GDDCGLIQHG DVT   (SEQ ID NO: 1256)

LNR_M21  CHPLIREYCT HYDGDGECDK GCDSAKCKWD GDDCDMDVLA EVT   (SEQ ID NO: 1262)
```

```
                1                                          46
bKmutM01 CLPDEFQCGS GRCIPLTWVC DGLNDCGDGS DESPAHCSQD PEFHKV (SEQ ID NO: 19)

bKmutM03 CLPHEFQCGS GRCIPQTWVC DGLNDCGDGS DEWPAQCSQD PEFHKV (SEQ ID NO: 20)

bKmutM04 CLPHEFQCRS GRCIPQAWGC DGLNDCGDGS DESPAQCSQD PEFHKV (SEQ ID NO: 21)

bKmutM02 CLPDEFQCRS GRCIPQTWVC DGLNDCGDGS DESPAQCSQD PEFHKV (SEQ ID NO: 526)

bKmutM05 CLSDEFQCRS GRCIPQRWVC DGLNDCGDGS DEWPAQCSQD PEFHKV (SEQ ID NO: 465)

bKmutM07 CMTDEFRCRS GRCIPQTWVC DGLNDCGDGS DEWPAQCSQD PEFHKV (SEQ ID NO: 509)

bKmutM08 CPPDEFQCRS GWCIPQKWVC DGLNDCGDGS DESPALCSQD PEFHKV (SEQ ID NO: 563)
```

The following is a consensus sequence for the β-Klotho-binding monomers identified from the panning of the mutagenesis library constructed from β-Klotho M01. Framework cysteines denoted as C.

(SEQ ID NO: 185)
C[LMP][PST][DH]EF[QR]C[GR]SG[RW]CIP[LQR][AKRST]W[GV]CDGLNDCGDGSGE[SW]PA[HLQ]C;

C-terminal linker for all members of family 6; SQDPEFHKV (SEQ ID NO: 18)

The following is a summary of the β-Klotho monomers identified from the panning of the mutagenesis library constructed from β-Klotho M25 (SEQ ID NOS 564-569 and 569-574, respectively, in order of appearance, Family 7; see FIG. 13)

The following is a consensus sequence for the β-Klotho-binding monomers identified from the panning of the mutagenesis library constructed from β-Klotho M25. Framework cysteines denoted as C.

(SEQ ID NO: 194)
C[RW][PST][GS][AEHQS]F[HQ]C[NS][NT]GHCLS[APQRS][ST]WVCDG[FY][DEVY]DC[DEG]D[GW]SDE[ASV][KN]C;

C-terminal linker for all members of family 7; PTHT (SEQ ID NO: 575)

The following is a summary of the β-Klotho monomers identified from the panning of the mutagenesis library constructed from β-Klotho M42 (SEQ ID NOS 576-579, respectively, in order of appearance, Family 8; see FIG. 13)

```
                1                                39
bKmutM09 CLPSQFQCNN GHCLSRTWVC DGYDDCGDWS DESNCPTHT (SEQ ID NO: 564)

bKmutM16 CRSSEFQCNN GHCLSATWVC DGYDDCEDGS DESNCPTHT (SEQ ID NO: 565)

bKmutM17 CRSSEFQCNT GHCLSRTWVC DGYDDCGDGS DEANCPTHT (SEQ ID NO: 566)

bKmutM19 CWSSAFQCNN GHCLSPSWVC DGYDDCGDGS DEANCPTHT (SEQ ID NO: 567)

bKmutM10 CLSGQFQCSN GHCLSRTWVC DGYVDCEDGS DEAKCPTHT (SEQ ID NO: 568)

bKmutM12 CRSGQFQCNN GHCLSATWVC DGYDDCDDGS DEANCPTHT (SEQ ID NO: 569)

bKmutM20 CRSGQFQCNN GHCLSATWVC DGYDDCDDGS DEANCPTHT (SEQ ID NO: 569)

bKmutM13 CRSGQFQCNN GHCLSQTWVC DGYDDCDDGS DEANCPTHT (SEQ ID NO: 570)

bKmutM14 CRSGQFQCNN GHCLSRTWVC DGYDDCDDGS DEANCPTHT (SEQ ID NO: 571)

bKmutM15 CRSGQFQCNN GHCLSSTWVC DGFDDCEDGS DEANCPTHT (SEQ ID NO: 572)

bKmutM11 CLSSSFQCNN GHCLSRTWVC DGYYDCEDGS DEVNCPTHT (SEQ ID NO: 573)

bKmutM18 CRTSHFHCNN GHRLSRTWVC DGYEDCEDGS DEANCPTHT (SEQ ID NO: 574)
```

```
            1                                              48
bKmutM21  CEPEEFRCRS GRCIPQTWLC DGLND-                  (SEQ ID NO: 576)
          CGDGS DEPPAHCSAP ASEPPGSL bKmutM22  CQPDEFTCRS GRCIPQSWLC DGLND-                  (SEQ ID NO: 577)
          CGDGS DEPPAHCSAP ASEPPGSL bKmutM23  CQPDEFTCSS GRCIPQIWLC DGLND-                  (SEQ ID NO: 578)
          CGDGS DERPEHCSAP ASEPPGSL bKmutM24  CQSDEFMCSS GRCIPVHWLC DGLND-                  (SEQ ID NO: 579)
          CGDGS DERPAQCSAP ASEPPGSL
```

The following is a consensus sequence for the β-Klotho-binding monomers identified from the panning of the mutagenesis library constructed from β-Klotho M42. Framework cysteines denoted as C.

(SEQ ID NO: 207)
C[EQ][PS][DE]EF[MRT]C[RS]SGRCIP[QV][HIST]WLCDGLN

DCGDGSDE[PR]P[AE][HQ]C;

C-terminal linker for all members of family 8; SAPASEPPGSL (SEQ ID NO: 12)

The following is a summary of the β-Klotho monomers identified from the panning of the mutagenesis library constructed from β-Klotho M50 (SEQ ID NOS 580-583, respectively, in order of appearance, Family 9; see FIG. 13)

The following is a consensus sequence for the β-Klotho-binding monomers identified from the panning of the mutagenesis library constructed from β-Klotho M50. Framework cysteines denoted as C.

(SEQ ID NO: 212)
C[HNP][STW]F[HN][HKQ]F[EK]CRN[GR]QCIPL[HY]LVCDGV

PDC[AG]D[DN]SDET[ADY]C;

C-terminal linker for all members of family 9; GDSHILPFSTPGPST (SEQ ID NO: 14)

```
           1                                             50 51
bKmutM25 CHSFNQFECR NRQCIPLYLV CDGVPDCADN SDETDCGDS. YLPFSTPGPS T (SEQ ID NO: 580)

bKmutM27 CNSFNQFECR NRQCIPLYLV CDGVPDCGDN SDETYCGDSH ILPFSTPGPS T (SEQ ID NO: 581)

bKmutM26 CHTFNKFECR NGQCIPLYLV CDGVPDCGDN SDETACGDSH ILPFSTPGPS T (SEQ ID NO: 582)

bKmutM28 CPWFHHFKCR NGQRIPLHLV CDGVPDCGDD SDETDCGDSH ILPFSTPGPS T (SEQ ID NO: 583)
```

The following is a summary of the β-Klotho walked dimers identified from the panning of the β-Klotho M01 N-terminal walked dimer library (SEQ ID NOS 584 and 584-590, respectively, in order of appearance, Family 10; see FIG. 14).

```
                  1                                                        50
BK_R1c_D06  CAPDQFRCSS GQCIPETWLC DGDDDCVDSS DEAGCASTV. ....PTCLPD bKWD12  CAPDQFRCSS GQCIPETWLC DGDDDCVDSS DEAGCASTV. ....PTCLPD bKWD14  CGPDQFRCKS GNCLPLNWVC DGVDDCGDSS DEEGCAT... ....PTCLPD

BK_R1c_D12  CGPDQFKCNS GSCIPLTWVC DGDNDCGDDS DETDCTKR.. .....TCLPD bKWD11  CPPDQFRCRS GRCIPQHWLC DGLNDCGDGS DEANCEKR.. .....TCLPD bKWD15  CLPDEFQCGS GRCIPQTWVC DGLNDCGDGS DESPAHCSQD PEFHKVCPSN bKWD16  CLPDEFRCGS GRCIPQTWVC DGLNDCGDGS DETG CRRPG. ..PTCLPD bKWD13  CGPDEFRCNS GRCLPLDWRC DGVDDCEDGS DEAPDLCKTP ...ARTCLPD 51                                     94
BK_R1c_D06  EFQCGS.GRC IPQTWVCDGL NDCGDGSDES PAHCSQDPEF HKV.    (SEQ ID NO: 584)

bKWD12  EFQCGS.GRC IPQTWVCDGL NDCGDGSDES PAHCSQDPEF HKV.    (SEQ ID NO: 584)

bKWD14  EFQCGS.GRC IPQTWVCDGL NDCGDGSDES PAHCSQDPEF HKV.    (SEQ ID NO: 585)

BK_R1c_D12  EFQCGS.GRC IPQTWVCDGL NDCGDGSDES PAHCSQDPEF HKV.    (SEQ ID NO: 586)
```

```
bKWD11    EFQCGS.GRC  IPQTWVCDGL  NDCGDGSDES  PATCKAPVPT ....    (SEQ ID NO: 587)

bKWD15    QFPCRSTGIC  IPLAWVCDGL  NDCGDGSDES  PATCKAPVPT ....    (SEQ ID NO: 588)

bKWD16    EFQCGS.GRC  IPQTWVCDGL  NDCGDGSDES  QQCSAPASEP  PGSL   (SEQ ID NO: 589)

bKWD13    EFQCGS.GRC  IPQTWVCDGL  NDCGDGSDES  PAHCSQDPEF  HKV.   (SEQ ID NO: 590)
```

The following is a consensus sequence for the N-terminal monomers from the dimers identified from the panning of the β-Klotho M01 N-terminal walked dimer library. Framework cysteines denoted as C.

(SEQ ID NO: 217)
C[ELPQR][APS][DGIN][EGQ][FQ][FKPQRT][E]C[GNRS]
[NS]G[HNQR]C[IV]P[AELPQRV][AHPQRT]W[LRV]CDG[DEV]
[DNP]DC[GLQ]D[DGNS]SDE[AEKT][DGLNS][-A][-H]C

The following are the linkers between monomer domains 1 and 2 of the dimers identified from the panning of the β-Klotho M01 C-terminal walked dimer library.

```
       ASTVPT         (SEQ ID NO: 591)

ATPT           (SEQ ID NO: 592)

TKRT           (SEQ ID NO: 593)

EKRT           (SEQ ID NO: 594)

SQDPEFHKV      (SEQ ID NO: 18)

RRPGPT         (SEQ ID NO: 595)

KTPART         (SEQ ID NO: 596)
```

The following is a consensus sequence for the C-terminal monomers from the dimers identified from the panning of the β-Klotho M01 N-terminal walked dimer library. Framework cysteines denoted as C.

(SEQ ID NO: 597)
CLPDEFQC[SG]SGRCIPQ[HT]W[VL]CDGLNDCGDGSDE[PS]
PA[HT]C

The following are the β-Klotho M01-related sequences (on which the consensus alignment shown above (SEQ ID NO: 597) that provided the seeds for the selected walked dimers derived from the β-Klotho M01 N-terminal walked dimer library (SEQ ID NO: 1236)
CLPDEFQCSS  GRCIPQTWVC  DGLNDCGDGS  DESPAHC (SEQ ID NO: 1237)
CLPDEFQCGS  GRCIPQHWLC  DGLNDCGDGS  DEPPAHC (SEQ ID NO: 1238)
CLPDEFQCGS  GRCIPQTWVC  DGLNDCGDGS  DESPATC The following are the linkers incorporated at the C-termini of the dimers identified from the panning of the β-Klotho M01 N-terminal walked dimer library.

```
       SQDPEFHKV        (SEQ ID NO: 12)

KAPVPT           (SEQ ID NO: 24)

SAPASEPPGSL      (SEQ ID NO: 18)
```

The following is a summary of the β-Klotho walked dimers identified from the panning of the β-Klotho M01 C-terminal walked dimer library (SEQ ID NOS 598, 307, 599-600, 310, 308-309 and 601-606, respectively, in order of appearance, Family 11; see FIG. 14).

```
                        1                                                    50
BK_R1c_D14   CLPDEFQCGS  GRCIPQTWVC  DGLNDCGDGS  DEPPAHCSAP  ASEPPGSLCR bKWD01   CLPDEFQCGS  GRCIPQHWLC  DGLNDCGDGS  DEPPAHCSAP  ASEPPGSLCR

BK_R1c_D15   CLPDEFQCGS  GRCIPQTWVC  DGLNDCGDGS  DEPPAHCSAP  ASEPPGSLCR bKWD10   CLPDEFQCGS  GRCIPQTWVC  DGLNDCGDGS  DESPATCKAP  .....VPTCL bKWD06   CLPDEFQCGS  GRCIPQTWVC  DGLNDCGDGS  DESPAHCSQD  PEF..HKVCQ bKWD02   CLPDEFQCSS  GRCIPQTWVC  DGLNDCGDGS  DESPAHCSQD  PEF..HKVCP bKWD03   CLPDEFQCGS  GRCIPQTWVC  DGLNDCGDGS  DESPAHCSQD  PEF..HKVCR bKWD04   CLPDEFQCGS  GRCIPQTWVC  DGLNDCGDGS  DESPAHCSQD  PEF..HKVCL bKWD07   CLPDEFQCGS  GRCIPQTWVC  DGLNDCGDGS  DESPAHCSQD  PEF..HKVCE bKWD08   CLPDEFQCGS  GRCIPQTWVC  DGLNDCGDGS  DESPAHCSQD  PEF..HKVCQ
```

```
                 -continued
BK_R1c_D16  CLPDEFQCGS GRCIPQTWVC DGLNDCGDGS DESPAHCSQD PEF..HKVCP bKWD05   CLPDEFQCGS GRCIPQTWVC DGLNDCGDGS DESPAHCSQD PEF..HKVCL bKWD09   CLPDEFQCGS GRCIPQTWVC DGLNDCGDGS DESPAHCSQD PEF..HKVCP 51                                       95
BK_R1c_D14  SD.EFRCGNG RCIPLTWVCD GEDDCQDSSD ETGCTTPGHT .....    (SEQ ID NO: 598)

bKWD01   AG.EFRCSNG RCVPLTWLCD GEDDCQDNSD EKNCAQPT.. .....    (SEQ ID NO: 307)

BK_R1c_D15  SN.QFTCGNG NCIPQPWVCD GEDDCGDDSD EESCKEHT.. .....    (SEQ ID NO: 599)

bKWD10   PD.EFKCGSG RCIPLRWVCD GDDDCQDGSD ETDCGGAEPT .....    (SEQ ID NO: 600)

bKWD06   PN.EFQCGNG RCIPAQWLCD GEDDCQDNSD EEDCTEHT.. .....    (SEQ ID NO: 310)

bKWD02   SS.EFRCNNG RCIPLHWVCD GDDDCQDNSD ETDCERSGRT .....    (SEQ ID NO: 308)

bKWD03   PG.EFRCNNG RCVPQTWVCD GEDDCGDNSD ETDCSAPASE PPGSL    (SEQ ID NO: 309)

bKWD04   SD.QFRCGNG RCVPRAWLCD GDNDCQDGSD ETNCEQPT.. .....    (SEQ ID NO: 601)

bKWD07   SIGQFECGNG HCIPPTWLCD GVNDCQDSSD EALAHCEPPT .....    (SEQ ID NO: 602)

bKWD08   SN.EFRCRNG QCIPLTWLCD GDNDCLDSSD EESCPAHT.. .....    (SEQ ID NO: 603)

BK_R1c_D16  PG.QFRCNNG RCIPVHWRCD GENDCQDDSD EKSCKGPEHT .....    (SEQ ID NO: 604)

bKWD05   PG.QFPCGNG RCIPETWLCD GDDDCQDGSD EKGCTASGRT .....    (SEQ ID NO: 605)

bKWD09   SG.EFTCGSG RCIPPTWVCD GEPDCLDGSD EKSCTATVRT .....    (SEQ ID NO: 606)
```

The following is a consensus sequence for the N-terminal monomers from the dimers identified from the panning of the β-Klotho M01 C-terminal walked dimer library. Framework cysteines denoted as C.

```
                                          (SEQ ID NO: 607)
CLPDEFQCGS GRCIPQTWVC DGLNDCGDGS DEPPAHC
```

The following are the linkers between monomer domains 1 and 2 of the dimers identified from the panning of the β-Klotho M01 C-terminal walked dimer library.

```
SAPASEPPGSL        (SEQ ID NO: 18)
KAPVPT             (SEQ ID NO: 24)
SQDPEFHKV          (SEQ ID NO: 12)
```

The following is a consensus sequence for the C-terminal monomers from the dimers identified from the panning of the β-Klotho M01 C-terminal walked dimer library. Framework cysteines denoted as C.

```
                                          (SEQ ID NO: 232)
C[AGLP]PD[EQ]F[KR]C[GKNRS]SG[NQRS]C[IL]P[ELQ]
[DHNT]W[LRV]CDG[DLV][DN]DC[EGV]D[GS]SDE[AET]
[DGNP][-D][-L]C
```

The following are the linkers at the C-termini of the dimers identified from the panning of the β-Klotho M01 C-terminal walked dimer library.

```
TTPGHT             (SEQ ID NO: 608)
AQPT               (SEQ ID NO: 609)
KEHT               (SEQ ID NO: 610)
GGAEPT             (SEQ ID NO: 611)
TEHT               (SEQ ID NO: 612)
ERSGRT             (SEQ ID NO: 613)
SAPASEPPGSL        (SEQ ID NO: 12)
EQPT               (SEQ ID NO: 614)
EPPT               (SEQ ID NO: 615)
PAHT               (SEQ ID NO: 616)
KGPEHT             (SEQ ID NO: 617)
TASGRT             (SEQ ID NO: 618)
TATVRT             (SEQ ID NO: 619)
```

The following is a summary of the β-Klotho walked dimers identified from the panning of the β-Klotho M06 N-terminal walked dimer library (SEQ ID NOS 620 and 620-622, respectively, in order of appearance, Family 12; see FIG. 14).

```
            1                                       50
BK_R1c_D09  CASNQFRCGN .GHCLSRTWL CDGVNDCEDG SDEADCSAPA SEPPGSLCPP bKWD18   CASNQFRCGN .GHCLSRTWL CDGVNDCEDG SDEADCSAPA SEPPGSLCPP
```

```
bKWD19   CAPDEFRCHN  TGTCIPRAWL  CDGDNDCGDG  SDEEGCKG..  ...SGPTCPP bKWD20   CAPSQFQCHD  NNICLLEGLL  CDGEDDCADG  SDEADCAAP.  ....EHTCPP 51                                     95
BK_R1c_D09  SQFTCGNGRC  VSLGWVCDGL  NDCGDGSDES  PALCSAPASE PPGSL    (SEQ ID NO: 620)

bKWD18   SQFTCGNGRC  VSLGWVCDGL  NDCGDGSDES  PALCSAPASE PPGSL    (SEQ ID NO: 620)

bKWD19   SQFTCGNGRC  VSLGWVCDGL  NDCGDGSDES  PALCSAPASE PPGSL    (SEQ ID NO: 621)

bKWD20   SQFTCGNGRC  VSLGWVCDGL  NDCGDGSDES  PALCSAPASE PPGSL    (SEQ ID NO: 622)
```

The following is a consensus sequence for the N-terminal monomers from the dimers identified from the panning of the β-Klotho M06 N-terminal walked dimer library. Framework cysteines denoted as C.

```
                                              (SEQ ID NO: 240)
CA[PS][DNS][EQ]F[QR]C[GH][DN][GNT][GHN][-IT]C[IL]

[LPS][ER][AGT][WL]LCDG[DEV][DN]DC[AEG]DGSDE[AE]

[DG]C
```

The following are the linkers between monomer domains 1 and 2 of the dimers identified from the panning of the β-Klotho M06 N-terminal walked dimer library.

```
        SAPASEPPGSL          (SEQ ID NO: 12)

KGSGPT               (SEQ ID NO: 623)

AAPEHT               (SEQ ID NO: 624)
```

The following is a consensus sequence for the C-terminal monomers from the dimers identified from the panning of the β-Klotho M06 N-terminal walked dimer library. Framework cysteines denoted as C.

```
                                          (SEQ ID NO: 625)
   CPPSQFTCGNGRCVSLGWVCDGL NDCGDGSDES PALC
```

The following is the linker at the C-termini of the dimers identified from the panning of the β-Klotho M06 N-terminal walked dimer library.

```
        SAPASEPPGSL          (SEQ ID NO: 12)
```

The following is a summary of the β-Klotho walked dimers identified from the panning of the β-Klotho M06 C-terminal walked dimer library (SEQ ID NOS 626-628, respectively, in order of appearance, Family 13; see FIG. 14).

The following is a consensus sequence for the N-terminal monomers from the dimers identified from the panning of the β-Klotho M06 C-terminal walked dimer library. Framework cysteines denoted as C.

```
                                          (SEQ ID NO: 625)
   CPPSQFTCGNGRCVSLGWVCDGL NDCGDGSDES PALC
```

The following is the linker between monomer domains 1 and 2 of the dimers identified from the panning of the β-Klotho M06 C-terminal walked dimer library.

```
        SAPASEPPGSL          (SEQ ID NO: 12)
```

The following is a consensus sequence for the C-terminal monomers from the dimers identified from the panning of the β-Klotho M06 C-terminal walked dimer library. Framework cysteines denoted as C.

```
                                              (SEQ ID NO: 245)
C[AP]P[DG][EQ]F[RT]C[KNR][NS]G[QR]C[IV]P[LQ][AHP]W

[LV]CDG[DE][DN]DC[GQ]DNSDE[EST][DNP][-A][-T]C
```

The following are the linkers at the C-termini of the dimers identified from the panning of the β-Klotho M06 C-terminal walked dimer library.

```
        KATVPT               (SEQ ID NO: 629)

ESPGPT               (SEQ ID NO: 630)

KRSVRT               (SEQ ID NO: 631)
```

The following is a summary of the β-Klotho walked dimers identified from the panning of the β-Klotho M08 N-terminal walked dimer library (SEQ ID NOS 632-633, 311 and 634, respectively, in order of appearance, Family 14; see FIG. 14).

```
               1                                               50
BK_R1c_D19    CPPSQFTCGN  GRCVSLGWVC  DGLNDCGDGS  DESPALCSAP  ASEPPGSLCA   (SEQ ID NO: 626)
BK_R1c_D20    CPPSQFTCGN  GRCVSLGWVC  DGLNDCGDGS  DESPALCSAP  ASEPPGSLCP   (SEQ ID NO: 627)
bKWD17        CPPSQFTCGN  GRCVSLGWVC  DGLNDCGDGS  DESPALCSAP  ASEPPGSLCP   (SEQ ID NO: 628)

51                                   91
BK_R1c_D19    PGEFTCKSGQ  CIPLHWLCDG  DNDCGDNSDE  SPATCKATVP  T
BK_R1c_D20    PGQFRCNNGR  CIPQPWLCDG  DDDCQDNSDE  ENCESPGPT.  .
bKWD17        PDQFRCRNGR  CVPLAWVCDG  EDDCQDNSDE  TDCKRSVRT.  .
```

```
                  1                                          50
BK_R1c_D25   CRPNEFRCGN .GHCLSQTWV CDGVDDCLDG SDEESCGRPG PGATSAPAAC  (SEQ ID NO: 632)
bKWD21       CAPGEFTCKN TGRCIPLNWR CDGDDDCGDG SDETDCP... ......APTC  (SEQ ID NO: 633)
bKWD22       CPADEFRCSN TGRCVPLSWL CDGEDDCGDG SDETNCK... ......AHTC  (SEQ ID NO: 311)
bKWD23       CGPSQFQCSN .GRCLPATWV CDGDDDCLDG SDEASA.... ..T.CATRTC  (SEQ ID NO: 634)

51                                         98
BK_R1c_D25   PSNQFPCRGT GICIPLAWVC DGLNDCGDGS DESPATCKAP VPT.....
bKWD21       PSNQFPCRST GICIPLAWVC DGLNDCGDGS DESPAHCSAP ASEPPGSL
bKWD22       PSNQFPCRST GICIPLAWVC DGLNDCGDGS DESPATCKAP VPT.....
bKWD23       PSNQFPCRST GICIPLAWVC DGLNDCGDGS DESPAHCSQD PGFHKV..
```

The following is a consensus sequence for the N-terminal monomers from the dimers identified from the panning of the β-Klotho M08 N-terminal walked dimer library. Framework cysteines denoted as C.

(SEQ ID NO: 249)
C[AGPR][AP][DGNS][EQ]F[QRT]C[GSK]N[GT][GHR][-R]C

[ILV][PS][ALQ][NST]W[LRV]CDG[DEV]DDC[GL]DGSDE[AET]

[DNS][-A][-T]C

The following are the linkers between monomer domains 1 and 2 of the dimers identified from the panning of the β-Klotho M08 N-terminal walked dimer library.

```
         GRPGPGATSAPAA         (SEQ ID NO: 13)

PAPT                  (SEQ ID NO: 635)

KAHT                  (SEQ ID NO: 636)

ATRT                  (SEQ ID NO: 637)
```

The following is a consensus sequence for the C-terminal monomers from the dimers identified from the panning of the β-Klotho M08 N-terminal walked dimer library. Framework cysteines denoted as C.

(SEQ ID NO: 638)
CPSNQFPCRGTGICIPLAWVCDGLNDCGDGSDESPATC

The following are the linkers at the C-termini of the dimers identified from the panning of the β-Klotho M08 N-terminal walked dimer library.

```
         KAPVPT                (SEQ ID NO: 24)

SAPASEPPGSL           (SEQ ID NO: 12)

SQDPGFHKV             (SEQ ID NO: 25)
```

The following is a summary of the β-Klotho walked dimers identified from the panning of the β-Klotho M21 N-terminal walked dimer library (SEQ ID NOS 639-640, 312 and 641-643, respectively, in order of appearance, Family 15; see FIG. 14).

```
                  1                                          50
BK_R1c_D08   CASGEFTCN. NGQCVPLAWR CDGVNDCQDG SDE..KGCTP H.........  (SEQ ID NO: 639)
bKWD25       CGPDEFRCN. NGQCIPLPWR CDGVDDCGDN SDEPLEICQA P.........  (SEQ ID NO: 640)
bKWD29       CGADQFRCG. NGSCVPRAWR CDGVDDCGDG SDEAPEICET P.........  (SEQ ID NO: 312)
BK_R1c_D18   CPPDEFQCRG TKKCLPLAWV CDGDNDCEDD SDEESCAS.. ........AV  (SEQ ID NO: 641)
bKWD27       CGPDQFRCS. SGKCIPQHWL CDGLNDCGDG SDESPATCQR H.........  (SEQ ID NO: 642)
bKWD28       CGANEFQCRS TGICVPVEWV CDGDNDCGDG SDEPPVCGDS HILPFSTPGP  (SEQ ID NO: 643)

51                                         100
BK_R1c_D08   .TCQSNEFRC RSGRCIPQHW LCDGLNDCGD GSDESPAHCS QDPEFHKV..
bKWD25       .TCQSNEFRC RSGRCIPQHW LCDGLNDCGD GSDEPPAHCS APASEPPGSL
bKWD29       .TCQSNEFRC RSGRCIPQHW LCDGLNDCGD GSDES.QQCS APASEPPGSL
BK_R1c_D18   HTCQSNEFRC RSGRCIPQHW LCDGLNDCGD GSDES.QQCS APASEPPGSL
bKWD27       .TCQSNEFRC RSGRCIPQHW LCDGLNDCGD GSDES.QQCS APASEPPGSL
bKWD28       STCQPDEFTC SSGRCIPQPW LCDGLNDCGD GSDEPPAHCS APASEPPGSL
```

The following is a consensus sequence for the N-terminal monomers from the dimers identified from the panning of the β-Klotho M21 N-terminal walked dimer library. Framework cysteines denoted as C.

(SEQ ID NO: 254)
C[AGP][APS][DGN][EQ]F[QRT]C[GNRS][GNS][GT][GKQS]

[-IK]C[ILV]P[LQRV][AEHP]W[LRV]CDG[DLV][DN]DCGD[GN]

SDE[AEKPS][GLPS][-AEV][-IT]C

The following are the linkers between monomer domains 1 and 2 of the dimers identified from the panning of the β-Klotho M21 N-terminal walked dimer library.

```
         TPHT                  (SEQ ID NO: 644)

QAPT                  (SEQ ID NO: 645)

ETPT                  (SEQ ID NO: 646)

ASAVHT                (SEQ ID NO: 647)

QRHT                  (SEQ ID NO: 648)

GDSHILPFSTPGPST       (SEQ ID NO: 14)
```

The following is a consensus sequence for the C-terminal monomers from the dimers identified from the panning of the β-Klotho M21 N-terminal walked dimer library. Framework cysteines denoted as C.

```
                                                   (SEQ ID NO: 649)
CQSNEFRCRSGRCIPQHWLCDGLNDCGDGSDE[SP][-P][AQ]QC
```

The following are the linkers at the C-termini of the dimers identified from the panning of the β-Klotho M21 N-terminal walked dimer library.

```
        SQDPEFHKV           (SEQ ID NO: 18)

SAPASEPPGSL         (SEQ ID NO: 12)
```

The following is a summary of the β-Klotho walked dimers identified from the panning of the β-Klotho M21 C-terminal walked dimer library (SEQ ID NOS 650-651, respectively, in order of appearance, Family 16; see FIG. 14).

```
           1                                            50
bKWD24   CQSNEFRCRS GRCIPQHWLC DGLNDCGDGS DES.QQCSAP ASEPPGSLCP  (SEQ ID NO: 650)
bKWD26   CQSNEFRCRS GRCIPQHWLC DGLNDCGDGS DEPPAHCSAP ASEPPGSLCA  (SEQ ID NO: 651)

51                               87
bKWD24   PGQFRCRNGS CIPATWLCDG DNDCGDNSDE EDCTPPT
bKWD26   ANQFTCGNGN CIPLHWVCDG DNDCQDGSDE TNCEEHT
```

The following is a consensus sequence for the N-terminal monomers from the dimers identified from the panning of the β-Klotho M21 C-terminal walked dimer library. Framework cysteines denoted as C.

The following are the linkers at the C-termini of the dimers identified from the panning of the β-Klotho M21 C-terminal walked dimer library.

```
              TPPT                (SEQ ID NO: 652)

EEHT                (SEQ ID NO: 653)
```

The following is a summary of the β-Klotho walked dimers identified from the panning of the β-Klotho M42 N-terminal walked dimer library (SEQ ID NOS 654-657, respectively, in order of appearance, Family 17; see FIG. 14).

```
                    1                                            50
        BK_R1c_D21  CPSGQFQCNN .GHCLSATWL CDGVDDCGDG SDEKGCGDSH ILPFSTPGPS  (SEQ ID NO: 654)
        BK_R1c_D24  CRPDEFPCRS TGRCVPRRWV CDGVDDCGDN SDESLAHCQT P.........  (SEQ ID NO: 655)
        bKWD31      CAPDQFRCKS .GNCIPLAWR CDGEDDCRDG SDEESCSAPA SEPPGS....  (SEQ ID NO: 656)
        bKWD32      CQAGQFQCES .GNCVPPNWL CDGENDCADS SDEANCRRAA H.........  (SEQ ID NO: 657)

51                                           99
        BK_R1c_D21  TCQPDEFTCS SGRCIPQPWL CDGLNDCGDG SDEPPAHCSA PASEPPGSL
        BK_R1c_D24  TCQPDEFTCS SGRCIPQPWL CDGLNDCGDG SDEPPAHCSA PASEPPGSL
        bKWD31      LCQPDEFTCS SGRCIPQPWL CDGLNDCGDG SDEPPAHCSA PASEPPGSL
        bKWD32      TCQPDEFTCS SGRCIPLAWV CDGLNDCGDG SDESPATCKA PVPT.....
```

The following is a consensus sequence for the N-terminal monomers from the dimers identified from the panning of the β-Klotho M42 N-terminal walked dimer library Framework cysteines denoted as C.

```
                                                   (SEQ ID NO: 649)
CQSNEFRCRSGRCIPQHWLCDGLNDCGDGSDE[SP][-P][AQ]QC
```

The following is the linker between monomer domains 1 and 2 of the dimers identified from the panning of the β-Klotho M21 C-terminal walked dimer library.

```
        SAPASEPPGSL         (SEQ ID NO: 12)
```

The following is a consensus sequence for the C-terminal monomers from the dimers identified from the panning of the β-Klotho M21 C-terminal walked dimer library. Framework cysteines denoted as C.

```
                                                   (SEQ ID NO: 262)
C[AP][AP][GN]QF[RT]C[GR]NG[NS]CIP[AL][HT]W[LV]CDG
DNDC[GQ]D[GN]SDE[ET][DN]C
```

```
                                                   (SEQ ID NO: 265)
C[APQR][ASP][DG][EQ]F[PQ]C[EKNR][NS][GT][GHN][-R]
C[ILV][PS][ALPR][ANRT]W[LRV]CDG[EV][DN]DC[AGR]D
[GNS]SDE[ARKS][GLNS][-A][-H]C
```

The following are the linkers between monomer domains 1 and 2 of the dimers identified from the panning of the β-Klotho M42 N-terminal walked dimer library.

```
        GDSHILPFSTPGPST     (SEQ ID NO: 14)

QTPT                (SEQ ID NO: 658)
```

| SAPASEPPGSL | (SEQ ID NO: 12) |
| RRAAHT | (SEQ ID NO: 29) |

The following is a consensus sequence for the C-terminal monomers from the dimers identified from the panning of the β-Klotho M42 N-terminal walked dimer library. Framework cysteines denoted as C.

(SEQ ID NO: 659)
CQPDEFTCSSGRCIP[LQ][AP]W[LV]CDGLNDCGDGSDEPPAHC

An additional seed sequence containing multiple mutations in the β-Klotho M42 monomer domain was identified in the output from the panning of the β-Klotho M42 N-terminal walked dimer library.

(SEQ ID NO: 1239)
CQPDEFQCGS GRCIPQTWVC DGLNDCGDGS DESPAHC

The following are the linkers at the C-termini of the dimers identified from the panning of the β-Klotho M42 N-terminal walked dimer library.

| SAPASEPPGSL | (SEQ ID NO: 12) |
| KAPVPT | (SEQ ID NO: 24) |

The following is a summary of the β-Klotho walked dimers identified from the panning of the β-Klotho M42 C-terminal walked dimer library (SEQ ID NOS 660-662, respectively, in order of appearance, Family 18; see FIG. 14).

```
              1                                              50
BK_R1c_D22  CQPDEFTCSS GRCIPQPWLC DGLNDCGDGS DEPPAHCSAP ASEPPGSLCR (SEQ ID NO: 660)
BK_R1c_D23  CQPDEFTCSS GRCIPQPWLC DGLNDCGDGS DEPPAHCSAP ASEPPGSLCR (SEQ ID NO: 661)
bKWD30      CQPDEFQCGS GRCIPQTWVC DGLNDCGDGS DESPAHCSQD P..EFHKVCR (SEQ ID NO: 662)

51                          89
BK_R1c_D22  PDEFRCKNGR CIPQTWVCDG EDDCQDSSDE TDCESTVRT
BK_R1c_D23  PDEFRCRNGR CVPLTWRCDG EDDCQDGSDE EGCAPPT..
bKWD30      PGEFQCGSGH CIPGPWVCDG DPDCQDGSDE ANCEQRT..
```

The following is a consensus sequence for the N-terminal monomers from the dimers identified from the panning of the β-Klotho M42 C-terminal walked dimer library. Framework cysteines denoted as C.

(SEQ ID NO: 663)
CQPDEFTCSSGRCIPQPWLCDGLNDCGDGSDEPPAHC

The following are the linkers between monomer domains 1 and 2 of the dimers identified from the panning of the β-Klotho M42 C-terminal walked dimer library.

| SAPASEPPGSL | (SEQ ID NO: 12) |
| SQDPEFHKV | (SEQ ID NO: 18) |

The following is a consensus sequence for the C-terminal monomers from the dimers identified from the panning of the β-Klotho M42 C-terminal walked dimer library. Framework cysteines denoted as C.

(SEQ ID NO: 270)
CRP[DG]EF[QR]C[GKR][NS]G[HR]C[IV]P[GLQ][PT]W[RV]
CDG[DE][DP]DCQD[GS]SDE[AET][DGN]C

The following are the linkers at the C-termini of the dimers identified from the panning of the β-Klotho M42 C-terminal walked dimer library.

| ESTVRT | (SEQ ID NO: 664) |
| APPT | (SEQ ID NO: 665) |
| EQRT | (SEQ ID NO: 28) |

The following is a summary of the β-Klotho walked dimers identified from the panning of the β-Klotho M50 N-terminal walked dimer library (SEQ ID NOS 666-674, respectively, in order of appearance, Family 19; see FIG. 14).

```
               1                                              50
BK_R1c_D05  CAAGQFRCHN SDTCLPGAWV CDGDNDCGDN SDEAS..... ....CQKRTC
BK_R1c_D07  CAPNEFRCRS TGRCIPVNWV CDGDDDCADN SDEAG..... ....CPEPTC
bKWD35      CAPGEFQCS. NGNCLPPNWL CDGVDDCGDG SDESAD.... ....CTEPTC
bKWD36      CAPDEFRCR. NGNCIPLPWV CDGENDCRDD SDEEDCEAPG .......RTC
bKWD38      CAAGEFQCS. SGRCLPRPWV CDGDNDCGDD SDETNCR... ....ASAHTC
bKWD39      CRSGEFRCK. NGRCIPQHWV CDGENDCGDD SDETNCGRQG PGATSAPAAC
BK_R1c_D10  CGADQFQCG. SGRCVPATWR CDGEDDCGDG SDEENCSQDP ....EFHKVC
bKWD37      CLSDQFQCNN YETCIPRPWL CDGDDDCVDG SDEED..... ....CETRTC
BK_R1c_D17  CLPGQFTCG. NGRCIPLPWV CDGVNDCEDN SDEESCEQH. ........TC
```

```
                    51                                                 100
BK_R1c_D05HSFNQFECRN  GQCIPLHLVC  DGVPDCGDNS  DETDCGDSHI  LPFSTPGPST    (SEQ ID NO: 666)

BK_R1c_D07HSFNRFECRN  GQCIPLHLVC  DGVPDCGDNS  DETDCGDSHI  LPFSTPGPST    (SEQ ID NO: 667)

bKWD35       HSFNQFECRN  GQCIPLHLVC  DGVPDCGDNS  DETDCGDPHI  LPFSTPGPST    (SEQ ID NO: 668)

bKWD36       HSFNQFECRN  GQCIPLHLVC  DGVPDCGDNS  DETDCGDSHI  LPFSTPGPST    (SEQ ID NO: 669)

bKWD38       HSFNQFECRN  GQCIPLHLVC  DGVPDCGDNS  DETDCGDSHI  LPFSTPGPST    (SEQ ID NO: 670)

bKWD39       HSFNQFECRN  GQCIPLHLVC  DGVPDCGDNS  DETDCGDSHI  LPFSTPGPST    (SEQ ID NO: 671)

BK_R1c_D10HSFNQFECRN  GQCIPLHLVC  DGVPDCGDNS  DETDCGDSHI  LPFSTPGPST    (SEQ ID NO: 672)

bKWD37       HSFNQFECRN  GQCIPLHLVC  DGVPDCGDNS  DETDCGDSHI  LPFSTPGPST    (SEQ ID NO: 673)

BK_R1c_D17HSFNQFECRN  GQCIPLHLVC  DGVPDCGDNS  DETDCGDSHI  LPFSTPGPST    (SEQ ID NO: 674)
```

The following is a consensus sequence for the N-terminal monomers from the dimers identified from the panning of the β-Klotho M50 N-terminal walked dimer library. Framework cysteines denoted as C.

(SEQ ID NO: 274)

C[AGLR][APS][DGN][EQ]F[RQT]C[GHKNRS][NS][GSTY]

[DEGNR][-RT]C[ILV]P[AGLPRV][AHNPT]W[LRV]CDG[DEV]

[DN]DC[AEGRV]D[DGN]SDE[AEST][ADGNS[-D]C

The following are the linkers between monomer domains 1 and 2 of the dimers identified from the panning of the β-Klotho M50 N-terminal walked dimer library.

```
            QKRT             (SEQ ID NO: 675)

PEPT             (SEQ ID NO: 676)

TEPT             (SEQ ID NO: 677)

EAPGRT           (SEQ ID NO: 678)

RASAHT           (SEQ ID NO: 679)

GRQGPGATSAPAA    (SEQ ID NO: 680)

SQDPEFHKV        (SEQ ID NO: 18)

ETRT             (SEQ ID NO: 681)

EQHT             (SEQ ID NO: 682)
```

The following is a consensus sequence for the C-terminal monomers from the dimers identified from the panning of the β-Klotho M50 N-terminal walked dimer library. Framework cysteines denoted as C.

(SEQ ID NO: 683)
CHSFNQFECRN GQCIPLHLVC DGVPDCGDNS DETDC

The following is the linker at the C-termini of the dimers identified from the panning of the β-Klotho M50 N-terminal walked dimer library.

GDPHILPFSTPGPST    (SEQ ID NO: 684)

The following is a summary of the β-Klotho walked dimers identified from the panning of the β-Klotho M50 C-terminal walked dimer library (SEQ ID NOS 685-686, respectively, in order of appearance, Family 20; see FIG. 14).

```
              1                                              50
bKWD33 CHSFNQFECR NGQCIPLHLV CDGVPDCGDN SDETDCGDSH ILPFSTPGPS bKWD34 CHSFNQFECR NGQCIPLHLV CDGVPDCGDN SDETDCGDSH ILPFSTPGPS 51                                             100
bKWD33 TCQSGEFRCQ NTRTCLPLKL LCDGVDDCLD DSDEKDCGTT GRT.......    (SEQ ID NO: 685)

bKWD34 TCLPGQFRCK TGR.CIPRAW VCDGVDDCED DSDEADCGRP GPGATSAPAA    (SEQ ID NO: 686)
```

The following is a consensus sequence for the N-terminal monomers from the dimers identified from the panning of the β-Klotho M50 C-terminal walked dimer library. Framework cysteines denoted as C.

(SEQ ID NO: 683)
CHSFNQFECRN GQCIPLHLVC DGVPDCGDNS DETDC

The following is the linker between monomer domains 1 and 2 of the dimers identified from the panning of the β-Klotho M50 C-terminal walked dimer library.

GDPHILPFSTPGPST    (SEQ ID NO: 684)

The following is a consensus sequence for the C-terminal monomers from the dimers identified from the panning of the β-Klotho M50 C-terminal walked dimer library. Framework cysteines denoted as C.

(SEQ ID NO: 284)
C[LQ][PS]G[EQ]FRC[KQ][NT][GT]R[-T]C[IL]P[LR][AK]

[LW][LV]CDGVDDC[EL]DDSDE[AK]DC

The following are the linkers at the C-termini of the dimers identified from the panning of the β-Klotho M50 C-terminal walked dimer library.

| | |
|---|---|
| GTTGRT | (SEQ ID NO: 687) |
| GRPGPGATSAPAA | (SEQ ID NO: 13) |

Example 8

This example describes generating and screening binding proteins made by combining FGFR1c- and βKlotho-binding monomers.

A PCR-based method was used in which pools of β-klotho- or FGFR1c-binding protein coding sequences were PCR-amplified, digested, and ligated together to create bispecific molecules.

In general, the coding sequences of (i) FGFR1c-binding monomers and (ii) beta-klotho-binding monomer and dimer binding proteins were individually PCR-amplified using 5' primer U_vs_for (ggtcatactgaaccgATGGCCGGTCCG-GCCTAC) (SEQ ID NO: 688) and 3' primer EveNut (aaa agg ccc cag agg cct tct gca atg a) (SEQ ID NO: 689) to create "products A." These genes were also PCR-amplified with 5' primer BpmI_for (atgccccgggtctggaggcgtctggtggttc) (SEQ ID NO: 690) and 3' primer EveNutUrescue (ggtaccatgcttg-cattcGGCCCCAGAGGCCTTCTGCAATGA) (SEQ ID NO: 691) to create "products B."

PCR products were purified with a Qiagen 96-well block and then digested with restriction endonucleases. "Products A" were digested with BsrDI, "Products B" with BpmI, and all were purified with a 96-well Qiagen block.

Two-fragment ligations were performed in 12 pools. In each ligation, 60-120 ng of each fragment were ligated in a volume of 10 μL using T4 DNA ligase (NEB) for 4 hours at room temperature. The ligated products (i.e., genes for the binding proteins) in 0.5 μL of ligation were preferentially PCR-amplified using 5' primer Rescue_fusion_for (ggtcat-actgaaccg) (SEQ ID NO: 692) and 3' primer Rescue1_rev (ggtaccatgcttgcattc) (SEQ ID NO: 693). Products were purified, digested with SfiI, then gel-purified, and subcloned into pEVE expression vector. Correct clones were identified by DNA sequencing.

FGFR1c/βKlotho Binding Proteins

A series of heterodimeric binding proteins was generated that would bind to both FGFR1c and β-Klotho (see FIGS. 22-23).

Figure 24A:
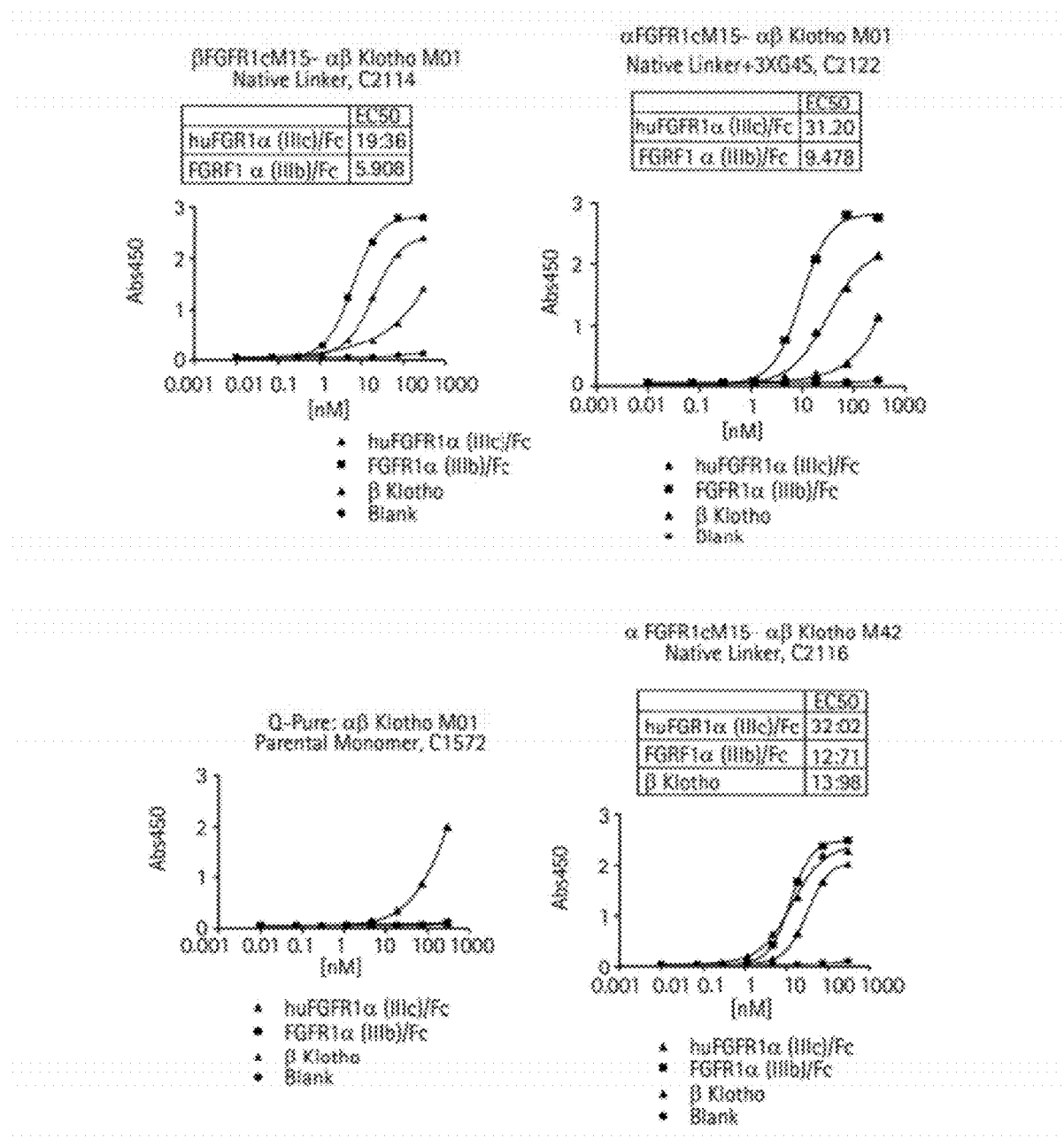
Figure 28:
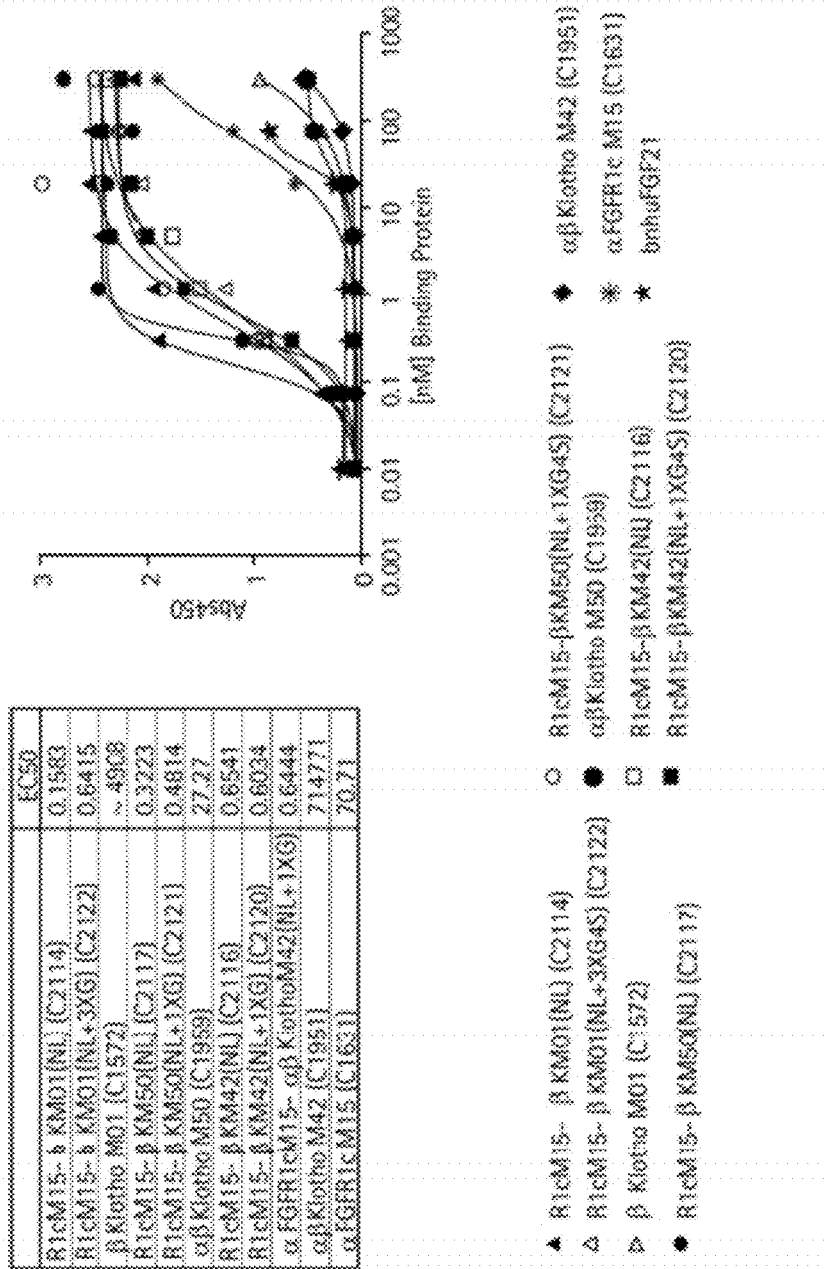
FIG. 28 is a table and plot generated using a binding ELISA demonstrating that binding proteins C2114 (SEQ ID NO: 1180), C2116 (SEQ ID NO: 1187), C2117 (SEQ ID NO: 1195) have improved affinity for the FGFR1c-β-Klotho complex over FGFR1c- and β-Klotho-binding monomers; 3XG4S is disclosed as SEQ ID NO: 4 and 1XG4S is disclosed as SEQ ID NO: 2.
Figure 30A:
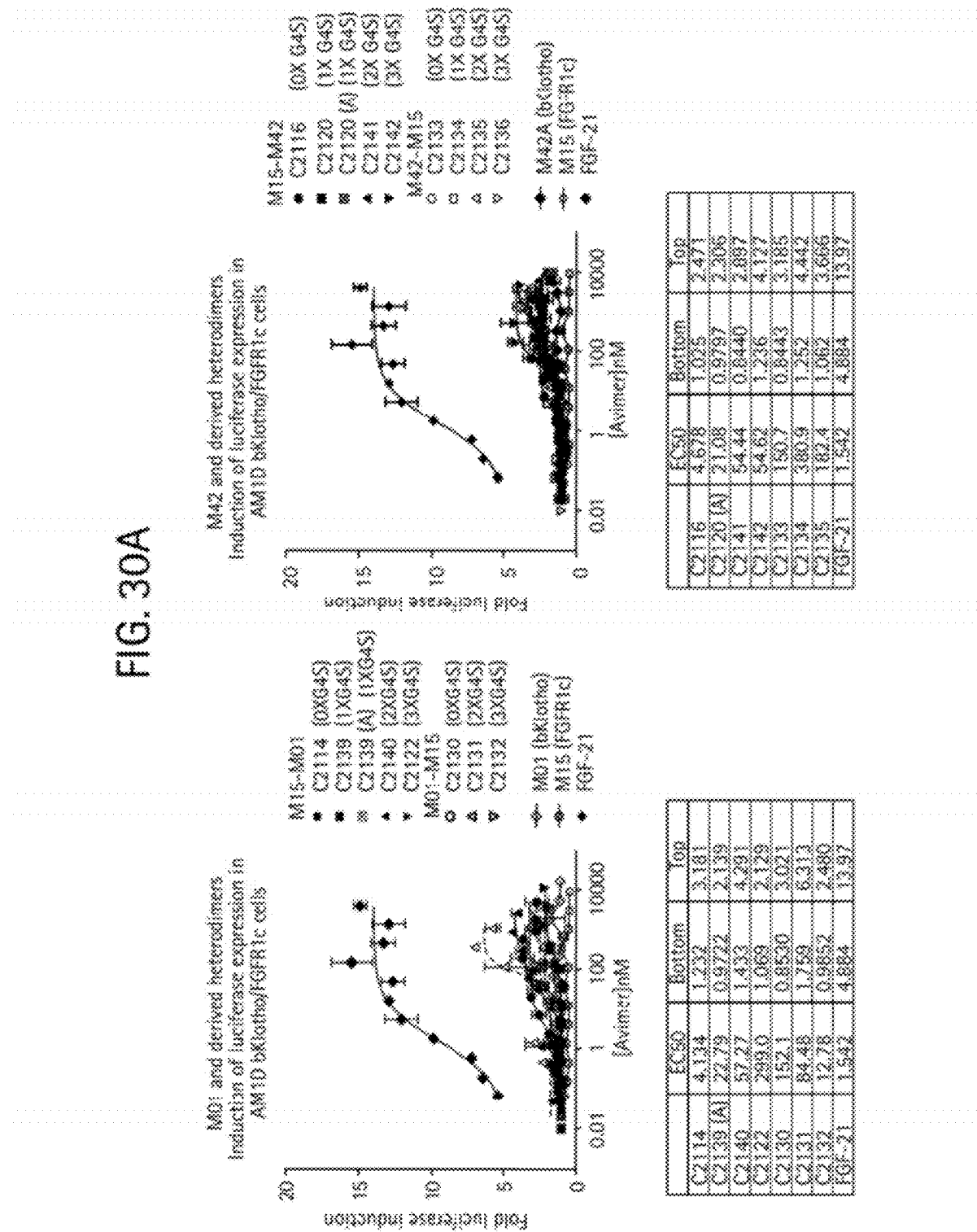
FIGS. 30A-30B are a series of plots and tables generated using a cell-based assay, demonstrating that the binding proteins shown in FIG. 29 (SEQ ID NOS 493 and 305-306, respectively, in order of appearance) exhibit agonistic activity against an FGF21 responsive reporter cell line; (0XG4S) & (1XG4S) are disclosed as SEQ ID NO: 2, (2XG4S) is disclosed as SEQ ID NO: 3 and (3XG4S) is disclosed as SEQ ID NO: 4.
Figure 30B:
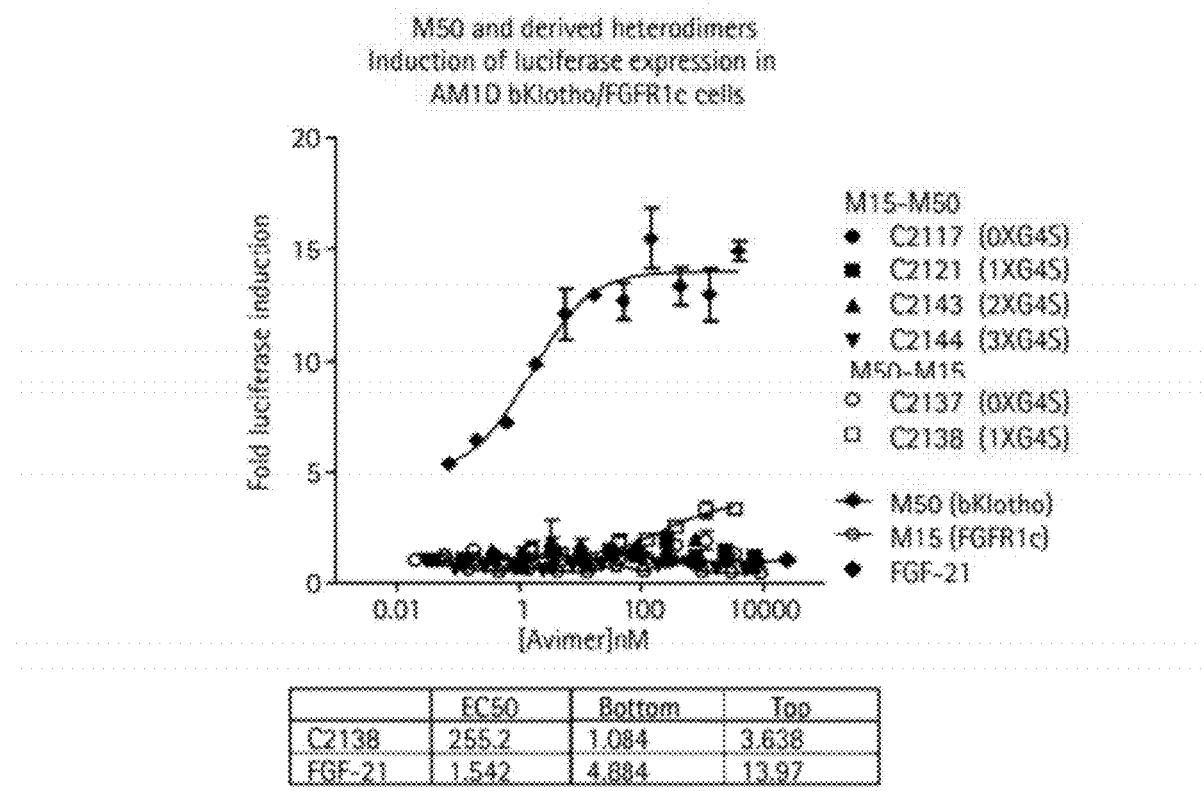

The following summarizes the FGFR1c monomers that were used to generate a set of binding proteins that were tested for agonist activity (see FIGS. 10, 15 and 16). The resulting bispecific multimers were shown to bind FGFR1c and β-Klotho by ELISA (FIG. 24) and Alphascreen (FIG. 25). The bispecific multimers may or may not block the binding of FGF-21 to the FGFR1c/β-Klotho complex in Alphascreen (FIG. 26) but do not block the association of FGFR1c and β-Klotho in Alphascreen (FIG. 27). The multimers exhibit increased avidity for the FGFR1c/β-Klotho complex relative to the isolated constituent warheads in binding ELISA (FIG. 28) and for the FGFR1c/β-Klotho complex on the surface of transfected cells by flow cytometry (FIG. 29). Additionally, the multimers induced an FGF-21 like agonist response when added to FGF-21 sensitive luciferase reporter cells (FIG. 30).

(SEQ ID NO: 287)
M03
CGAGLFTCRSTKICISQAWVCDGVDDCEDNSDEKNCSAPASEPPGSL (SEQ ID NO: 694)
M08
CGAGQFTCRDTNICISRAWRCDGVDDCEDNSDEADCSQDPEFHKV (SEQ ID NO: 289)
M15
CGANQFTCHNTNICISQAWVCDGVDDCEDNSDEKNCSAPASEPPGSL (SEQ ID NO: 290)
M23
CGSNQFTCRSTNICISQAWVCDGVDDCEDDSDETGCSQDPEFHKV (SEQ ID NO: 291)
M31
CLSDQFTCRSTNICLPLQWVCDGDDDCEDNSDEEDCSAPASEPPGSL (SEQ ID NO: 292)
M33
CRLNEFPCGSGSCISLHWVCDSVPDCRDDSDETDCPERT (SEQ ID NO: 293)
M03mut01
CGAGLFTCRSTNICISQVWVCDGVDDCEDNSDEDSCSAPASEPPGSL (SEQ ID NO: 294)
M03mut04
CGAGLFTCRSTNICISQAWVCDGVDDCEDNSDENYCSAPASEPPGSL (SEQ ID NO: 295)
M03mut05
CGAGLFTCRSTNICISQAWVCDGVDDCEDNSDETNCSAPASEPPGSL (SEQ ID NO: 296)
M03mut06
CGASLFTCRRSNICISQAWVCDGVDDCEDNSDEMNCSAPASEPPGSL (SEQ ID NO: 297)
M03mut09
CGEGLFTCRSTNICISHAWVCDGVDDCEDNSDENNCSAPASEPPGSL (SEQ ID NO: 298)
M23mut10
CGANLFTCQSTNICISDAWVCDGVDDCEDNSDETTCSQDPEFHKV (SEQ ID NO: 299)
M23mut11
CGANLFTCRSTNICISPAWVCDGVDDCEDYSDEIGCSQDPEFHKV (SEQ ID NO: 300)
M23mut14
CGSDMFTCRSTNICISKVWVCDGVDDCEDDSDERGCSQDPEFHKV (SEQ ID NO: 695)
M23mut15
CGSNLFTCRRTNICISKAWVCDGVDDCEDNSDETGCSQDPEFHKV (SEQ ID NO: 696)
M23mut16
CGSNLFTCRSTNICISPAWVCDGVDDCDDDSDETGCSQDPEFHKV (SEQ ID NO: 697)
M23mut17
CGTNLFTCRSTNMCISQAWVCDGVDDCEDNSDETVCSQDPEFHKV The following summarizes the β-Klotho monomers and dimers that were used to generate the set of binding proteins (see FIGS. 15, 16 and 32):

M01
SEQ ID NO: 304)
CLPDEFQCGSGRCIPQTWVCDGLNDCGDGSDESPAHCSQDPEFHKV

M42
SEQ ID NO: 305)
CQPDEFTCSSGRCIPQPWLCDGLNDCGDGSDEPPAHCSAPASEPPGSL

-continued

M50

(SEQ ID NO: 306)
CHSFNQFECRNGQCIPLHLVCDGVPDCGDNSDETDCGDSHILPFSTPGPS
T

LNR_M01

(SEQ ID NO: 1243)
CIAAKLCEALDGDGVCHKECDLEECDWDGGDCQRIFLTDPT

WD01

(SEQ ID NO: 307)
CLPDEFQCGSGRCIPQHWLCDGLNDCGDGSDEPPAHCSAPASEPPGSLCR

AGEFRCSNGRCVPLTWLCDGEDDCQDNSDEKNCAQPT

WD02

(SEQ ID NO: 308)
CLPDEFQCSSGRCIPQTWVCDGLNDCGDGSDESPAHCSQDPEFHKVCPSS

EFRCNNGRCIPLHWVCDGDDDCQDNSDETDCERSGRT

WD03

(SEQ ID NO: 309)
CLPDEFQCGSGRCIPQTWVCDGLNDCGDGSDESPAHCSQDPEFHKVCRPG

EFRCNNGRCVPQTWVCDGEDDCGDNSDETDCSAPASEPPGSL

WD04

(SEQ ID NO: 601)
CLPDEFQCGSGRCIPQTWVCDGLNDCGDGSDESPAHCSQDPEFHKVCLSD

QFRCGNGRCVPRAWLCDGDNDCQDGSDETNCEQPT

WD05

(SEQ ID NO: 1264)
CLPDEFQCGSGRCIPQTWVCDGLNDCGDGSDESPAHCSQDPEFHKVCLPG

QFPCGNGRCIPETWLCDGDDDCQDGSDEKGCAQPT

WD06

(SEQ ID NO: 310)
CLPDEFQCGSGRCIPQTWVCDGLNDCGDGSDESPAHCSQDPEFHKVCQPN

EFQCGNGRCIPAQWLCDGEDDCQDNSDEEDCTEHT

WD08

(SEQ ID NO: 603)
CLPDEFQCGSGRCIPQTWVCDGLNDCGDGSDESPAHCSQDPEFHKVCQSN

EFRCRNGQCIPLTWLCDGDNDCLDSSDEESCPAHT

WD21

(SEQ ID NO: 633)
CAPGEFTCKNTGRCIPLNWRCDGDDDCGDGSDETDCPAPTCPSNQFPCRS

TGICIPLAWVCDGLNDCGDGSDESPAHCSAPASEPPGSL

WD22

(SEQ ID NO: 311)
CPADEFRCSNTGRCVPLSWLCDGEDDCGDGSDETNCKAHTCPSNQFPCRS

TGICIPLAWVCDGLNDCGDGSDESPATCKAPVPT

WD25

(SEQ ID NO: 640)
CGPDEFRCNNGQCIPLPWRCDGVDDCGDNSDEPLEICQAPTCQSNEFRCR

SGRCIPQHWLCDGLNDCGDGSDEPPAHCSAPASEPPGSL

WD28

(SEQ ID NO: 643)
CGANEFQCRSTGICVPVEWVCDGDNDCGDGSDEPPVCGDSHILPFSTPGP

STCQPDEFTCSSGRCIPQPWLCDGLNDCGDGSDEPPAHCSAPASEPPGSL

WD29

(SEQ ID NO: 312)
CGADQFRCGNGSCVPRAWRCDGVDDCGDGSDEAPEICETPTCQSNEFRCR

SGRCIPQHWLCDGLNDCGDGSDESQQCSAPASEPPGSL

-continued

WD31

(SEQ ID NO: 313)
CLPDEFRCGNGNCISVAWRCDGVDDCEDGSDEEDCESPEHTCQSNEFRCR

SGRCIPQHWLCDGLNDCGDGSDESPAHCSQDPEFHKV

Preparation and Testing of Binding Proteins.

Figure 31B:
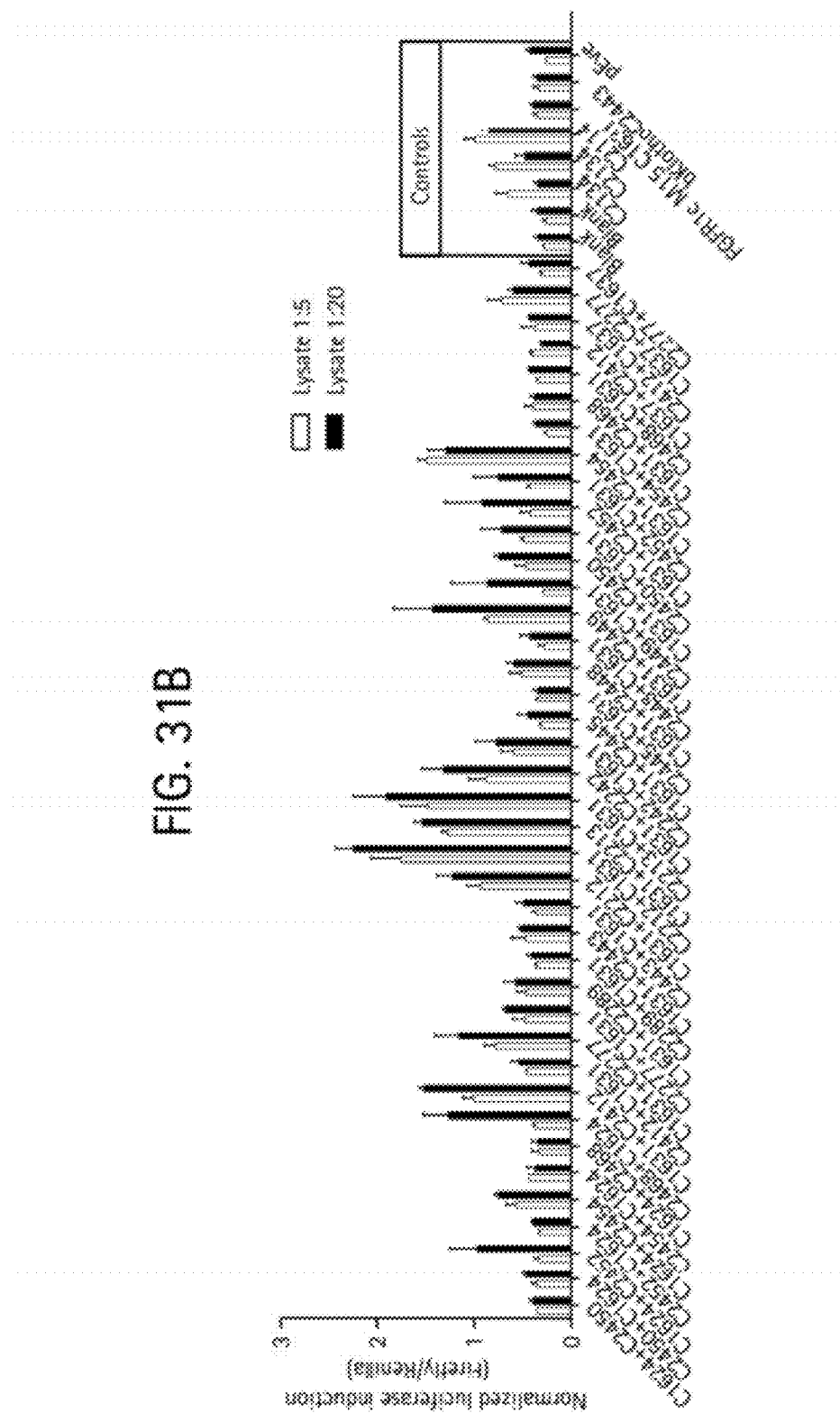
Figure 31C:
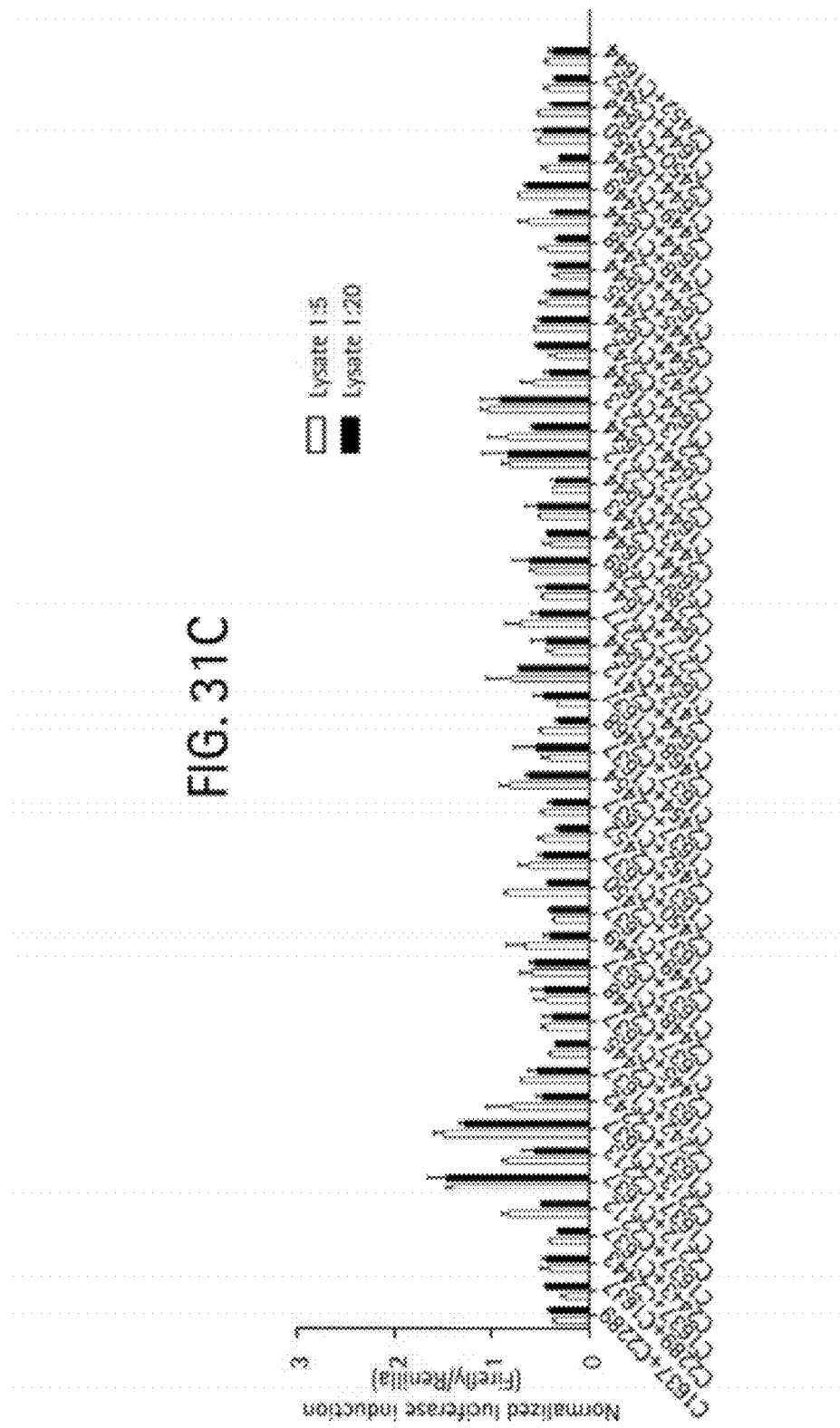
Figure 31D:
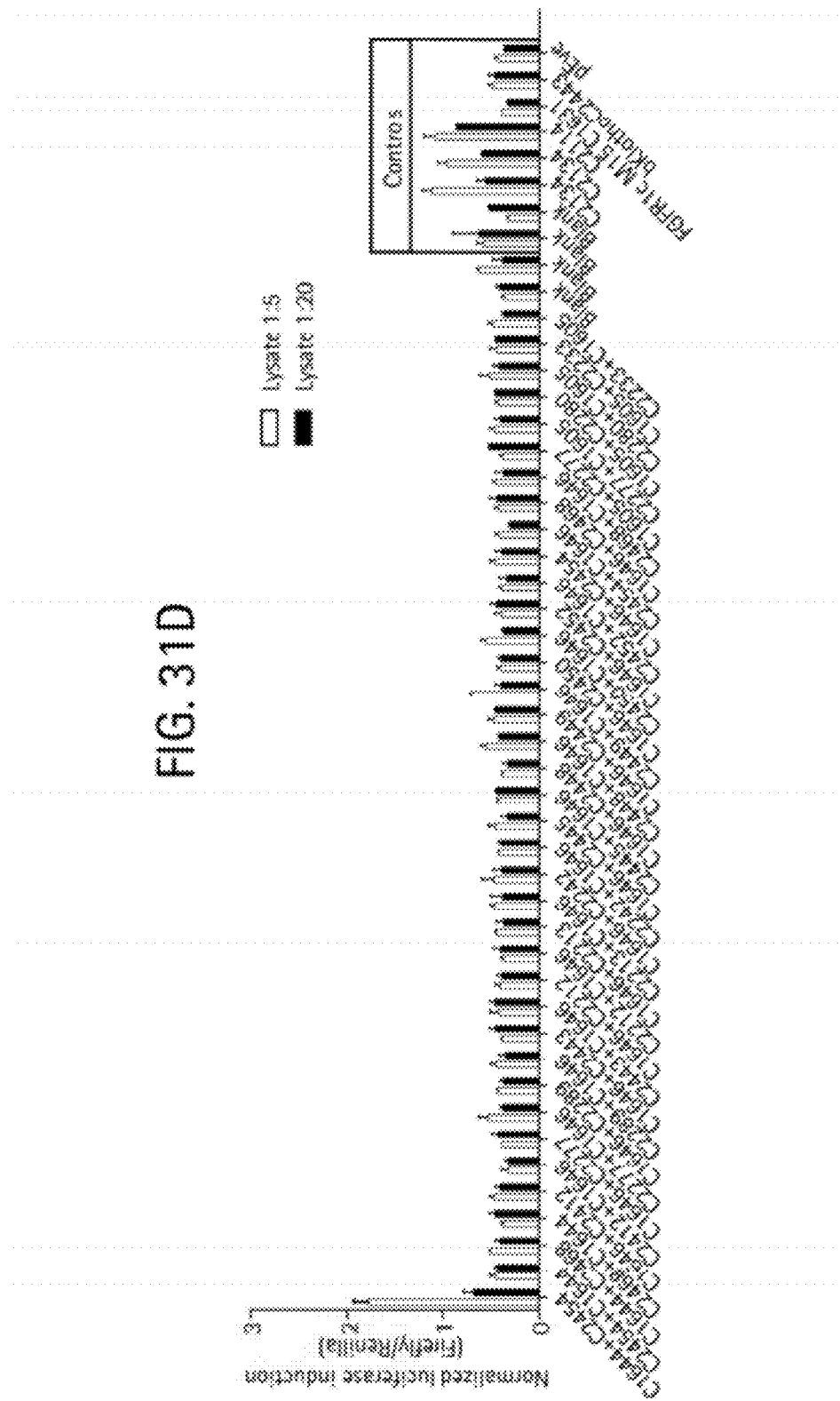
Figure 33:
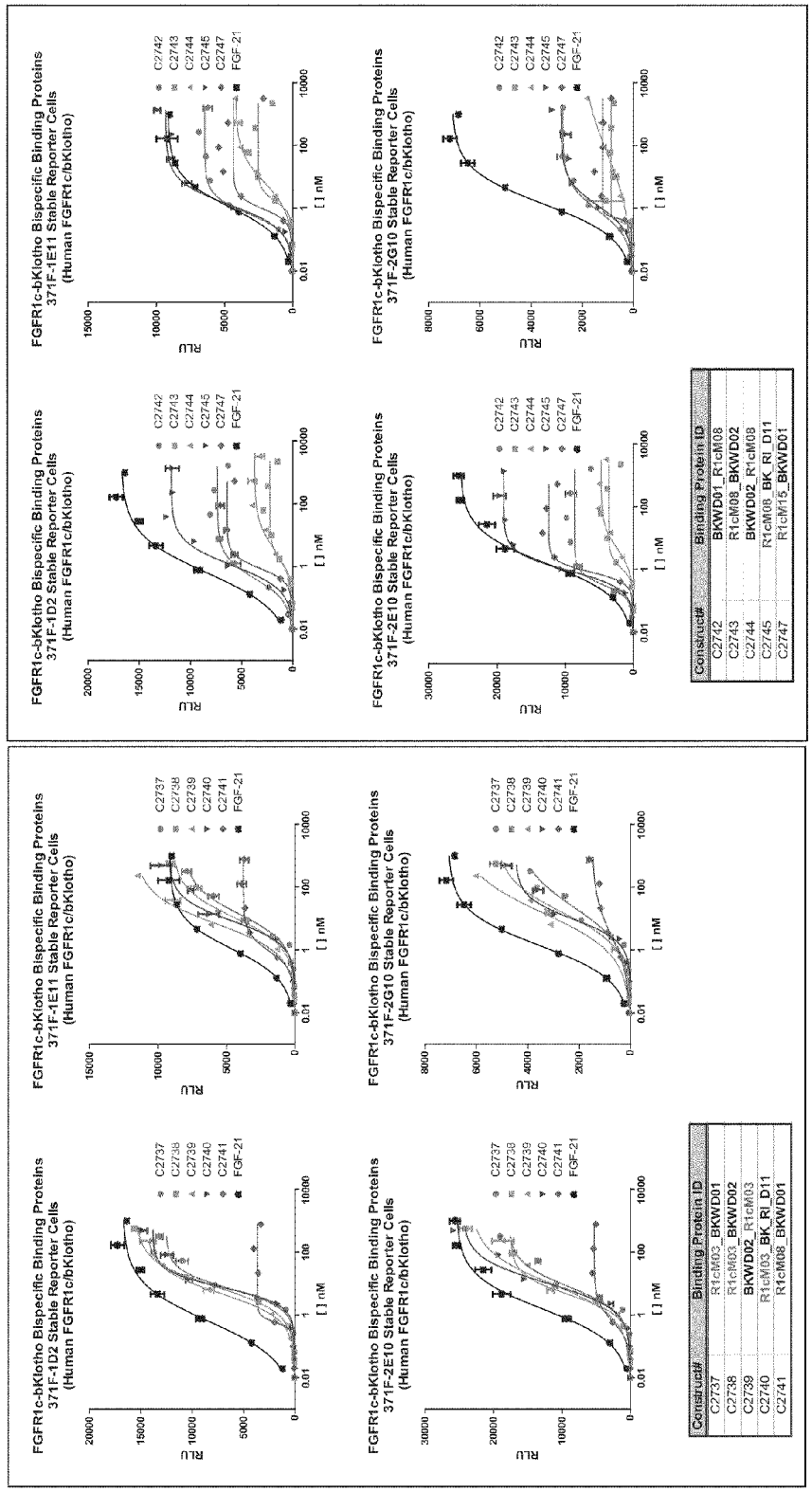
FIG. 33 is a series of plots generated using a cell-based assay that demonstrates binding proteins C2737 (SEQ ID NO: 370), C2738 (SEQ ID NO:371), C2739 (SEQ ID NO:372), C2740 (SEQ ID NO:373) and C2741 (SEQ ID NO:374) (left panel) and C2742 (SEQ ID NO:375), C2743 (SEQ ID NO:376), C2744 (SEQ ID NO:377), C2745 (SEQ ID NO:378) and C2747 (SEQ ID NO:379) (right panel) induce FGF21-like signaling activity in four different stable luciferase reporter cell lines.
Figure 34:
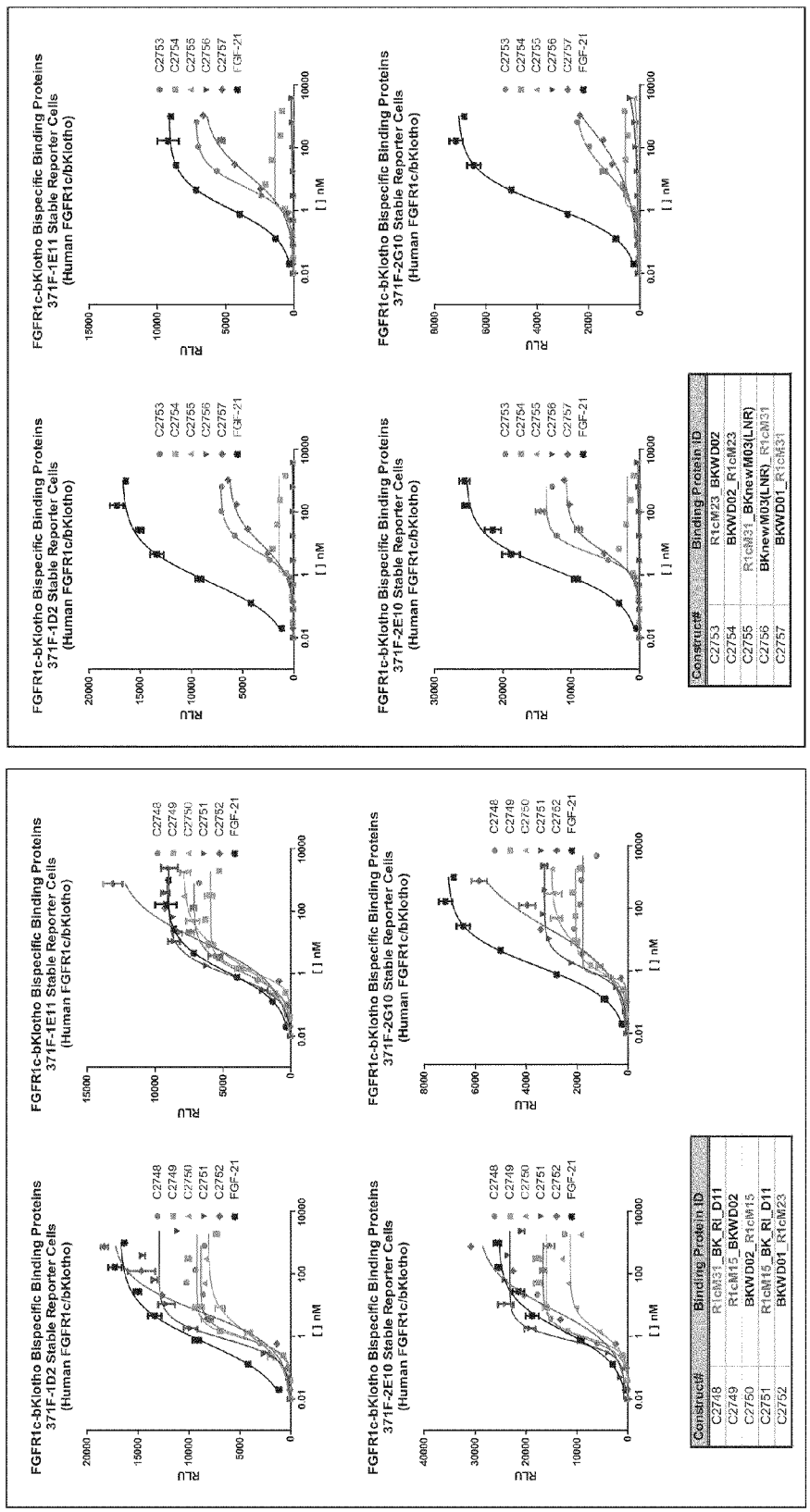
FIG. 34 is a series of plots generated using a cell-based assay that demonstrates binding proteins C2748 (SEQ ID NO:380), C2749 (SEQ ID NO:381), C2750 (SEQ ID NO:382), C2751 (SEQ ID NO:383) and C2752 (SEQ ID NO:384) (left panel) and C2753 (SEQ ID NO:385), C2754 (SEQ ID NO:386), and C2757 (SEQ ID NO:387) (right panel) induce FGF21-like signaling activity in four different stable luciferase reporter cell lines.
Figure 35:
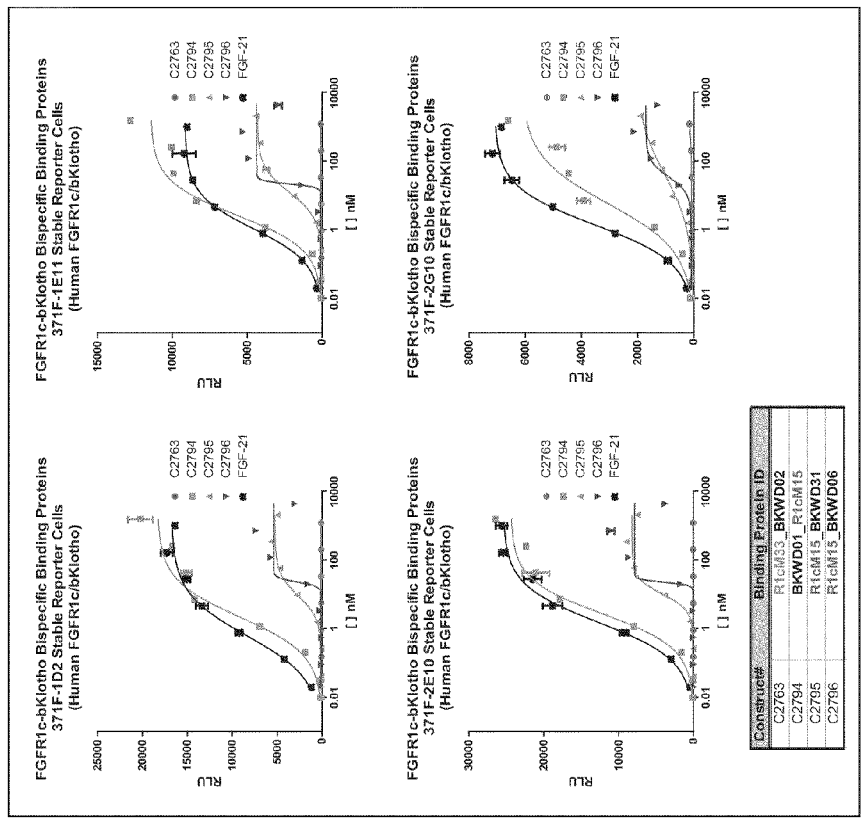
FIG. 35 is a series of plots generated using a cell-based assay that demonstrates binding proteins C2794 (SEQ ID NO:390), C2795 (SEQ ID NO:391) and C2796 (SEQ ID NO:392) induce FGF21-like signaling activity in four different stable luciferase reporter cell lines.

Binding proteins were initially screened for activity as crude preparations in bacterial lysate (see FIG. 31).

Protein Production of 1 mL heated lysates (Day 1): Individual clones were inoculated into wells of a 96-well Costar deep-well plate containing 500 μL/well of 2×YT/40 μg/mL kanamycin. Cultures were grown overnight (inoculating tips were left in wells) while shaken at 300 rpm at 37° C. This process allowed screening of thousands of individual, partially-purified monomers at the cell-lysate level.

(Day 2) 100 μL of overnight culture was inoculated into new 96-well Costar deep-well plate containing 1 mL/well of 2×YT/40 μg/mL kanamycin+1 mM $CaCl_2$. (The remaining overnight culture was archived by the addition of 25% final glycerol concentration and then stored at −80° C. for later use.) Plates were covered with AirPore Tape (Qiagen) and cultures were grown with shaking at 375 rpm at 37° C. until an $OD_{600}$ of ~0.8 to 1.0 was reached. Once the desired $OD_{600}$ was reached, cultures were induced with 1 mM IPTG for 3 hr while shaking at 375 rpm at 37° C. Plates containing induced cultures were then centrifuged for 15 min at 3600 rpm at 4° C. to pellet cells. Supernatant was removed and discarded, and the remaining cell pellet was resuspended in 100 μL of TBS [pH 7.5]/1 mM $CaCl_2$. Resuspended cells were transferred from the 96-well deep-well plate to a 96-well polypropylene PCR plate and heated for 5 min at 65° C. in a PCR machine. Heated/lysed cells were then centrifuged for 15 min at 3600 rpm at 4° C. After centrifugation, protein production was complete, and protein lysates were ready for characterization in ELISA, Alphascreen and an FGF-21 sensitive luciferase reporter cell assay.

After initial screening at the lysate level, selected FGFR1c/βKlotho binding proteins were selected for scaled-up expression and purification, using the same methods used for expressing and purifying the original warheads (see Example 7).

Example 9

This example describes experiments demonstrating activation of luciferase expression in a reporter cell line in response to FGF-21 and FGF-21 mimetic molecules Reporter cell lines used were derived from AM-1D, a cell line derived from Chinese Hamster Ovary (CHO) cells and obtained from the Amgen Research Cell Bank. Cell lines were maintained in Dulbecco's Modified Eagles Medium (DMEM)+10% fetal bovine serum (FBS) (Gibco) supplemented with non-essential amino acids (Mediatech) and sodium pyruvate (Mediatech)

An AM-1D cell line stably expressing human FGFR1c was derived (AM-1D-huFGFR1c). Transient transfection of this cell line in a 96 well plate format with pTT5-cyno β-Klotho (25 ng DNA/well), pFR-luciferase reporter construct (150 ng DNA/well) (Promega) and pFA-Ga14-Elk transactivator (10 ng/well DNA) (Stratagene) produces cells that are responsive to FGF-21.

AM-1D huFGFR1c cells were plated on day 1 at a density of $2.5×10^4$ cells/well on white poly-D-lysine coated 96 well plates (Becton Dickinson) and incubated overnight at 37° C., 5% $CO_2$. On day 2 cells were transfected with DNA as described herein and incubated overnight at 37° C., 5% $CO_2$.

On day 3 the medium was changed on the cells and replaced with assay medium (Ham's F12 medium+1% bovine serum albumin) On day 4 the assay was performed. Dilutions of test article (crude bacterial lysate containing a binding protein, or a purified binding protein) were made in assay medium and added to the 96 well plates. Each 96 well plate also included a positive control titration of human FGF-21. The cells were incubated at 37° C., 5% $CO_2$ for 4 hours, after which Promega Steadyglo luciferase reagent was added in a 1:1 ratio with mixing, according to the manufacturer's instructions. Agonist activity was directly proportional to the luminescence signal.

A series of AM-1D cell lines were derived that stably expressed human FGFR1c, human β-Klotho plus the Gal4-Elk transactivator and FA-luciferase reporter (371F series). Four clones were used in these studies (371F-1D2, 371F-1E11, 371F-2E10, 371F-2G10). AM-1D 371F cells were plated on day 1 at a density of $2.0 \times 10^4$ cells/well on white poly-D-lysine coated 96 well plates (Becton Dickinson) and incubated overnight at 37° C., 5% $CO_2$. On day 2 the medium was changed on the cells and replaced with assay medium (Ham's F12 medium+1% bovine serum albumin) On day 3 the assay was performed. Dilutions of test article (crude bacterial lysate containing a binding protein, or a purified binding protein) were made in assay medium and added to the 96 well plates. Each 96 well plate also included a positive control titration of human FGF-21. The cells were incubated at 37° C., 5% CO2 for 4 hours, after which Promega Steadyglo luciferase reagent was added in a 1:1 ratio with mixing, according to the manufacturer's instructions. Agonist activity was directly proportional to the luminescence signal.

These assays permitted the determination of the binding protein's potency and efficacy relative to each other and to native human FGF-21, allowing the ranking of the binding proteins based on their biological activity. Examples of data from this assay are shown in FIGS. 30, 31, 33-35, 38-49.

Example 10

Figure 37:
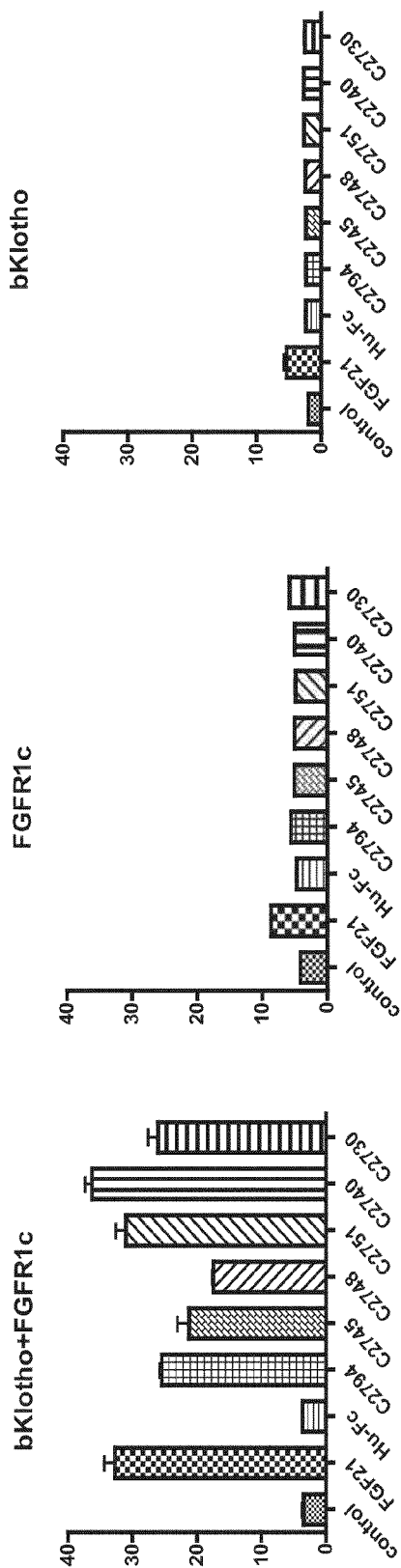
FIG. 37 is a series of bar graphs generated using a transiently transfected L6 cell-based assay and demonstrates that the ability of binding proteins C2794 (SEQ ID NO:390), C2745 (SEQ ID NO:378), C2748 (SEQ ID NO:380), C2751 (SEQ ID NO:383), and C2740 (SEQ ID NO:373) to induce FGF21-like signaling activity requires the presence of both FGFR1c and β-Klotho.
Figure 40A:
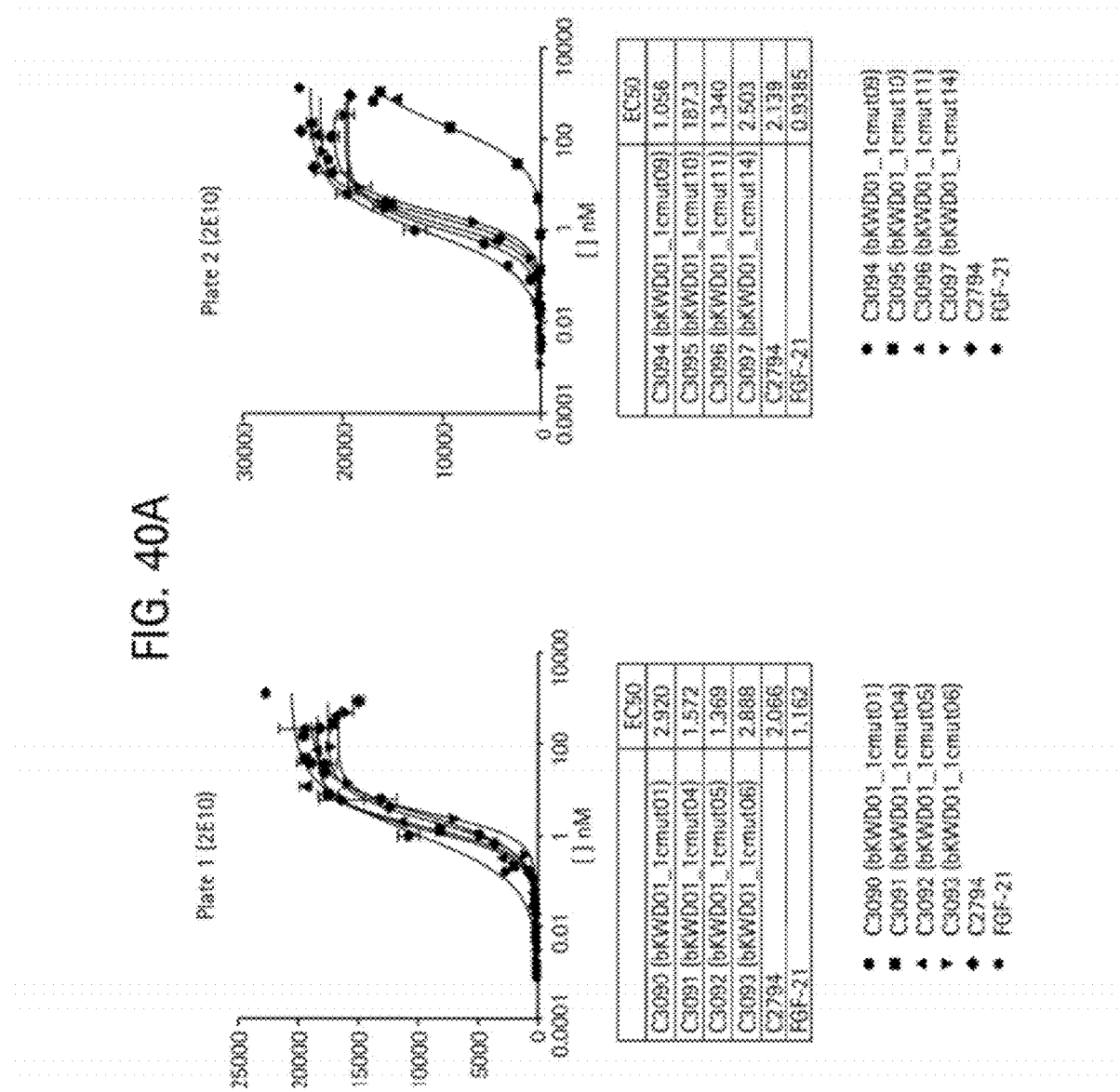
Figure 41A:
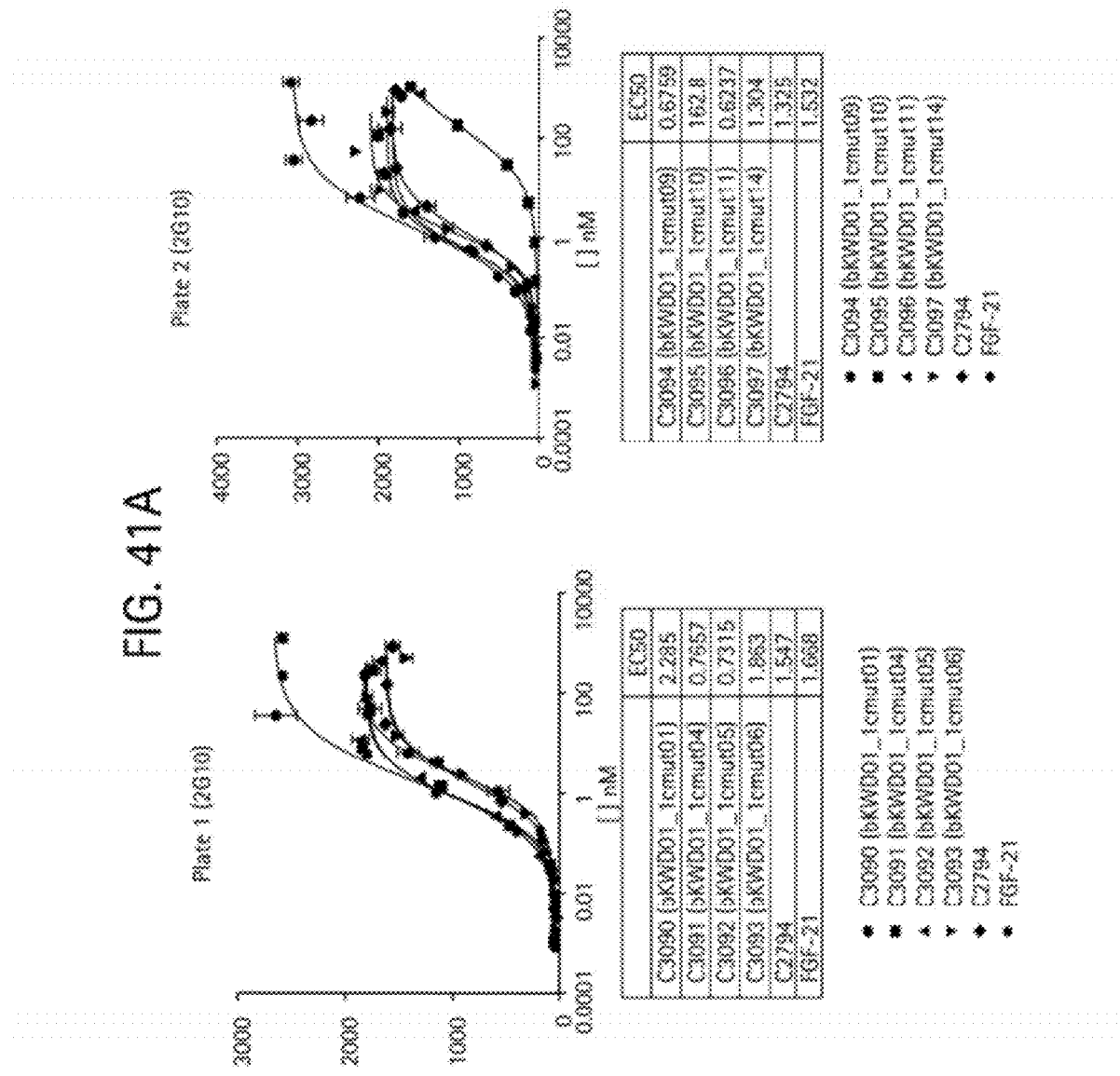
Figure 42:
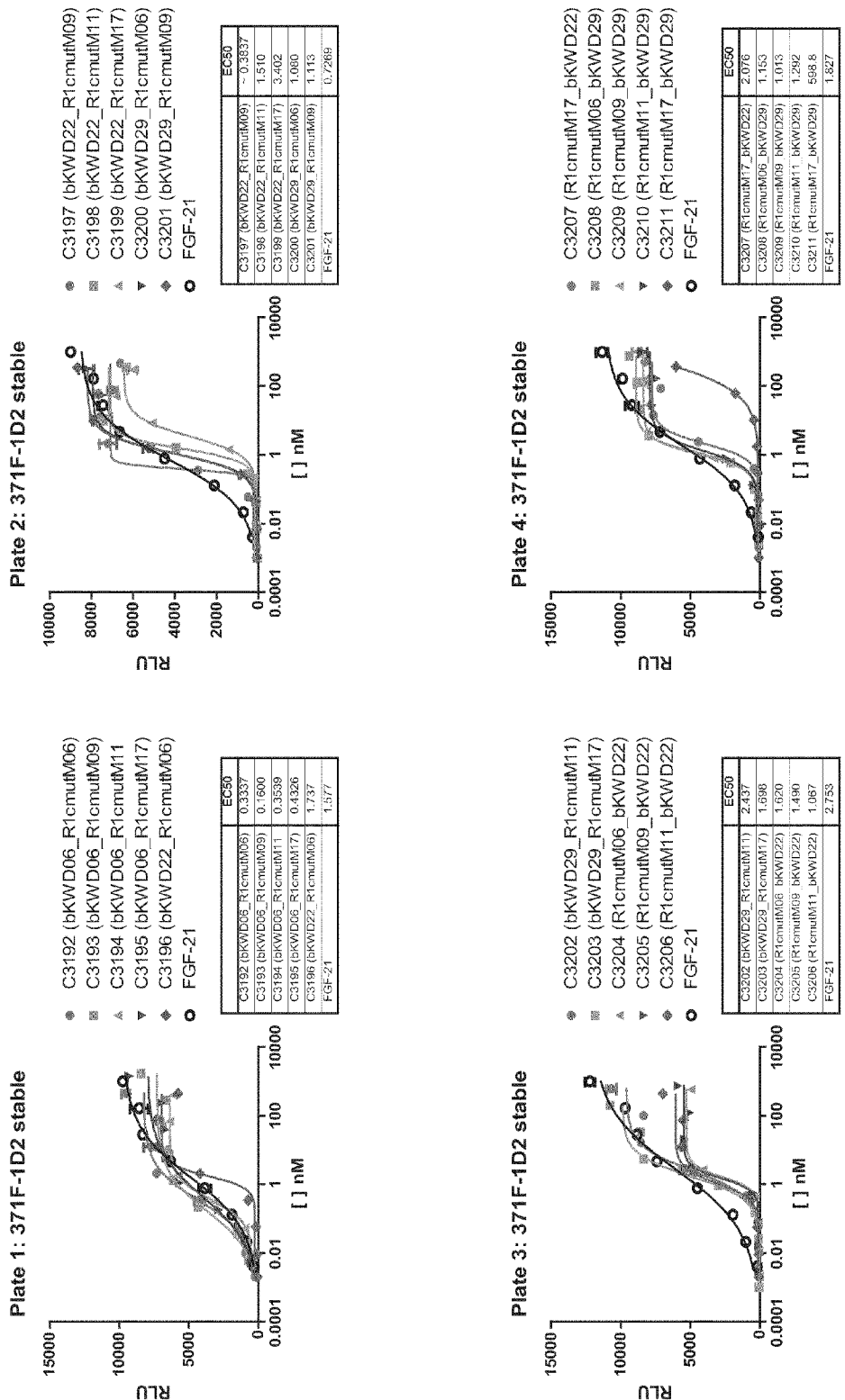
FIG. 42 is a series of plots generated using a cell-based assay that demonstrates that binding proteins C3192 (SEQ ID NO:350), C3193 (SEQ ID NO:351), C3194 (SEQ ID NO:352), C3195 (SEQ ID NO:353), C3196 (SEQ ID NO:354), C3197 (SEQ ID NO:355), C3198 (SEQ ID NO:356), C3199 (SEQ ID NO:357), C3200 (SEQ ID NO:358), C3201 (SEQ ID NO:359), C3202 (SEQ ID NO:360), C3203 (SEQ ID NO:361), C3204 (SEQ ID NO:362), C3205 (SEQ ID NO:363), C3206 (SEQ ID NO:364), C3207 (SEQ ID NO:365), C3208 (SEQ ID NO:366), C3209 (SEQ ID NO:367), C3210 (SEQ ID NO:368), and C3211 (SEQ ID NO:369) exhibit FGF21-like signaling activity in a first luciferase reporter cell line expressing human FGFR1c and β-Klotho.
Figure 43:
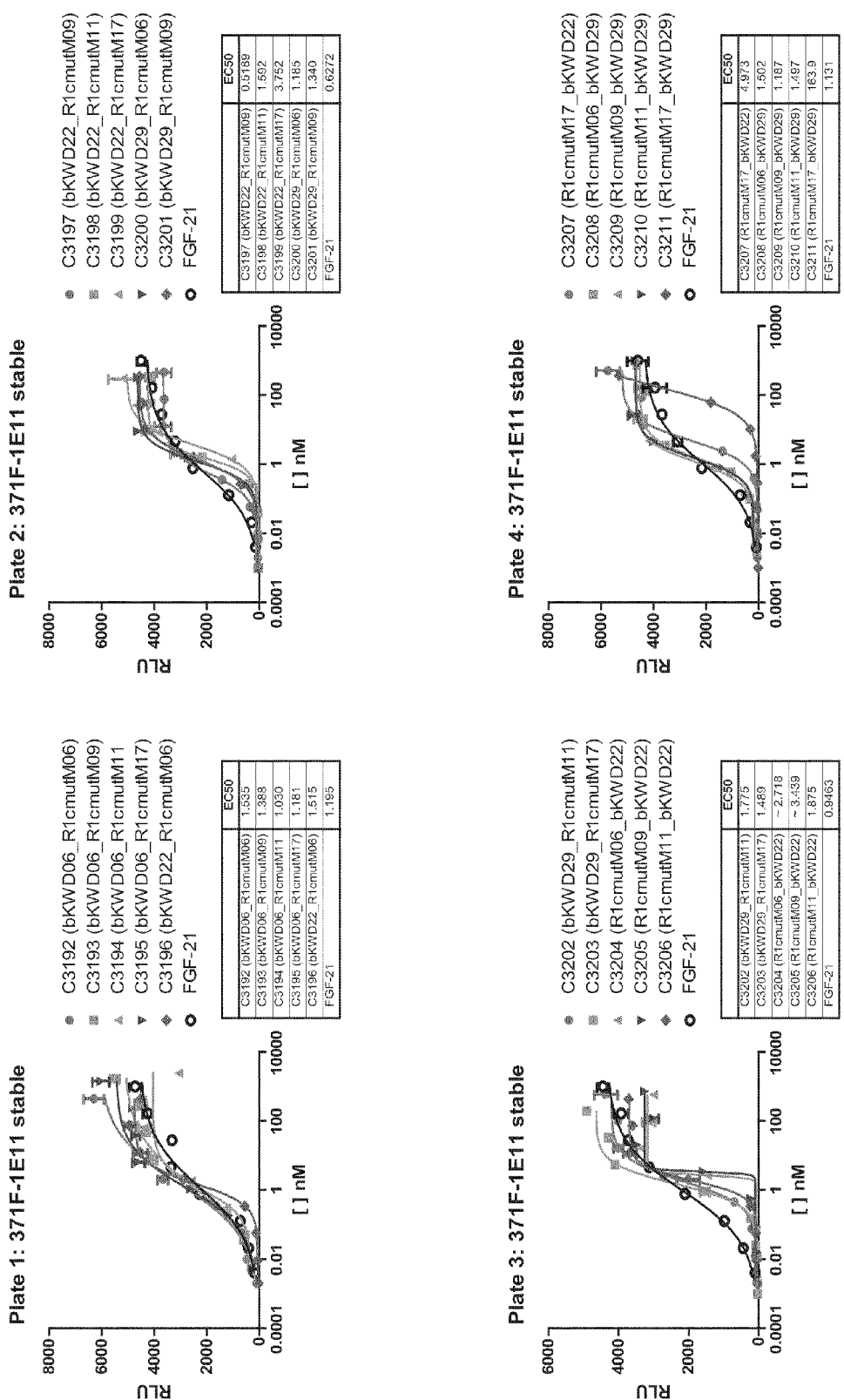
FIG. 43 is a series of plots generated using a cell-based assay that demonstrates that binding proteins C3192 (SEQ ID NO:350), C3193 (SEQ ID NO:351), C3194 (SEQ ID NO:352), C3195 (SEQ ID NO:353), C3196 (SEQ ID NO:354), C3197 (SEQ ID NO:355), C3198 (SEQ ID NO:356), C3199 (SEQ ID NO:357), C3200 (SEQ ID NO:358), C3201 (SEQ ID NO:359), C3202 (SEQ ID NO:360), C3203 (SEQ ID NO:361), C3204 (SEQ ID NO:362), C3205 (SEQ ID NO:363), C3206 (SEQ ID NO:364), C3207 (SEQ ID NO:365), C3208 (SEQ ID NO:366), C3209 (SEQ ID NO:367), C3210 (SEQ ID NO:368), and C3211 (SEQ ID NO:369) exhibit FGF21-like signaling activity in a second luciferase reporter cell line expressing human FGFR1c and β-Klotho.
Figure 44:
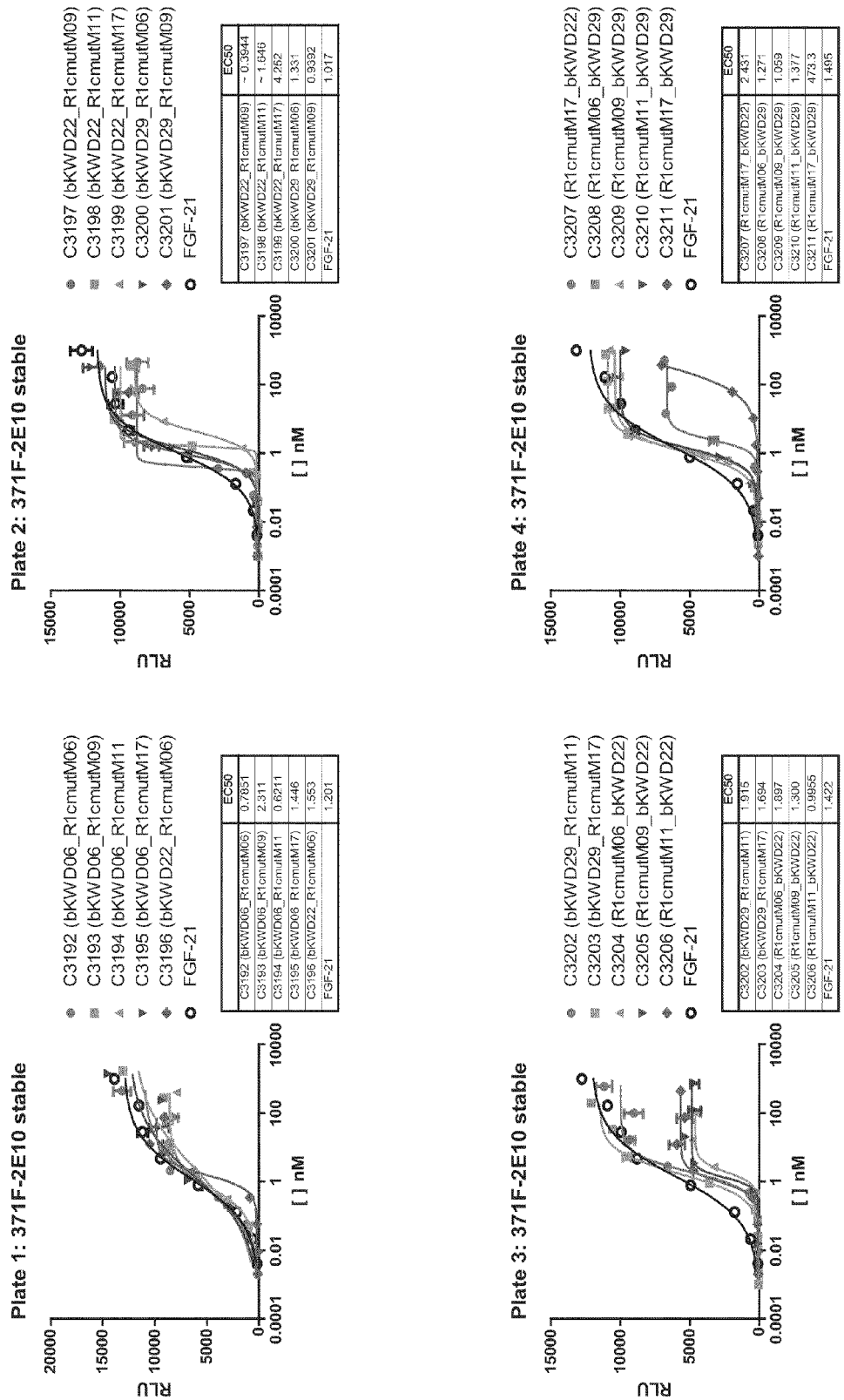
FIG. 44 is a series of plots generated using a cell-based assay that demonstrates that binding proteins C3192 (SEQ ID NO:350), C3193 (SEQ ID NO:351), C3194 (SEQ ID NO:352), C3195 (SEQ ID NO:353), C3196 (SEQ ID NO:354), C3197 (SEQ ID NO:355), C3198 (SEQ ID NO:356), C3199 (SEQ ID NO:357), C3200 (SEQ ID NO:358), C3201 (SEQ ID NO:359), C3202 (SEQ ID NO:360), C3203 (SEQ ID NO:361), C3204 (SEQ ID NO:362), C3205 (SEQ ID NO:363), C3206 (SEQ ID NO:364), C3207 (SEQ ID NO:365), C3208 (SEQ ID NO:366), C3209 (SEQ ID NO:367), C3210 (SEQ ID NO:368), and C3211 (SEQ ID NO:369) exhibit FGF21-like signaling activity in a third luciferase reporter cell line expressing human FGFR1c and β-Klotho.
Figure 45:
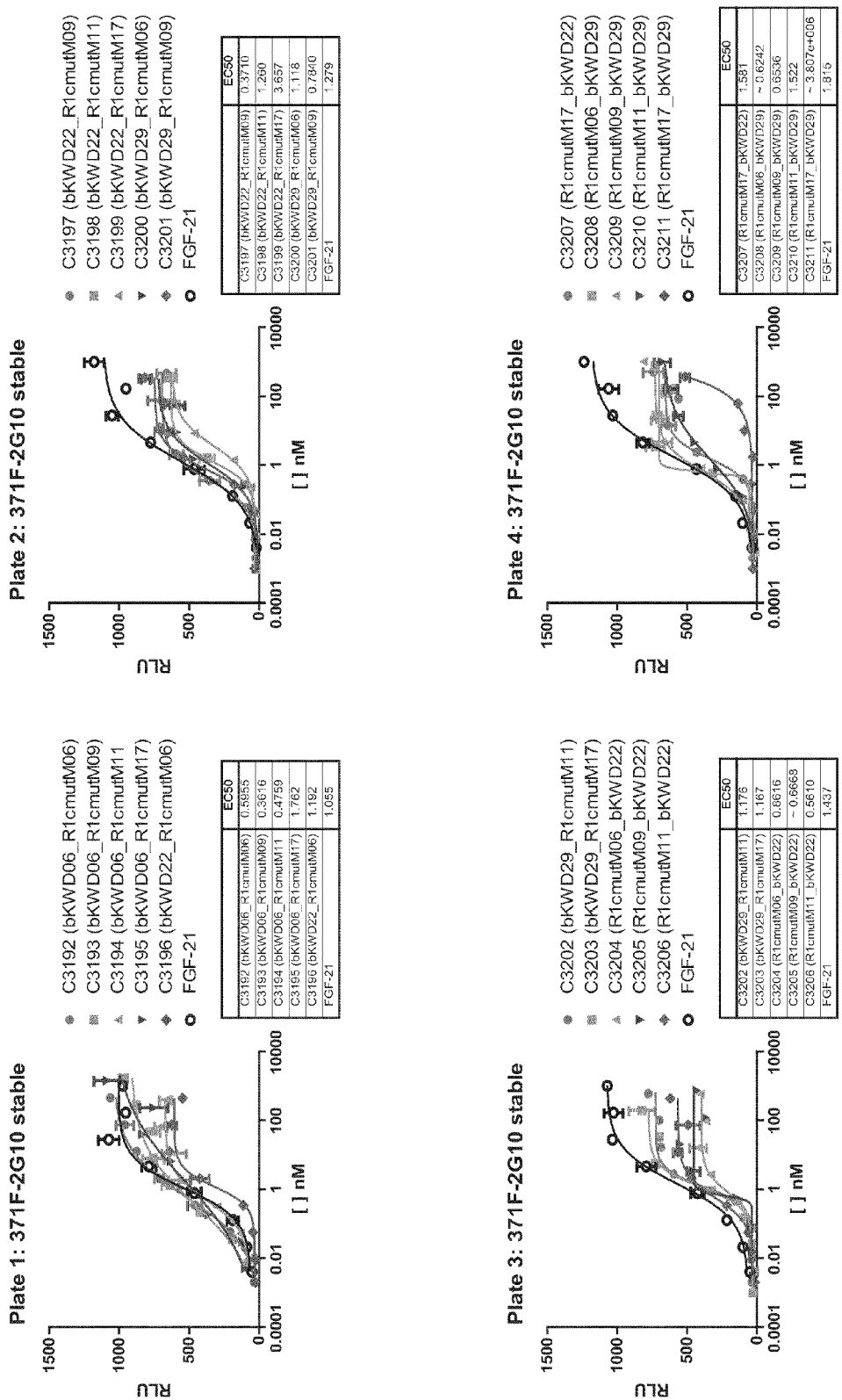
FIG. 45 is a series of plots generated using a cell-based assay that demonstrates that binding proteins C3192 (SEQ ID NO:350), C3193 (SEQ ID NO:351), C3194 (SEQ ID NO:352), C3195 (SEQ ID NO:353), C3196 (SEQ ID NO:354), C3197 (SEQ ID NO:355), C3198 (SEQ ID NO:356), C3199 (SEQ ID NO:357), C3200 (SEQ ID NO:358), C3201 (SEQ ID NO:359), C3202 (SEQ ID NO:360), C3203 (SEQ ID NO:361), C3204 (SEQ ID NO:362), C3205 (SEQ ID NO:363), C3206 (SEQ ID NO:364), C3207 (SEQ ID NO:365), C3208 (SEQ ID NO:366), C3209 (SEQ ID NO:367), C3210 (SEQ ID NO:368), and C3211 (SEQ ID NO:369) exhibit FGF21-like signaling activity in a fourth luciferase reporter cell line expressing human FGFR1c and β-Klotho.
Figure 47A:
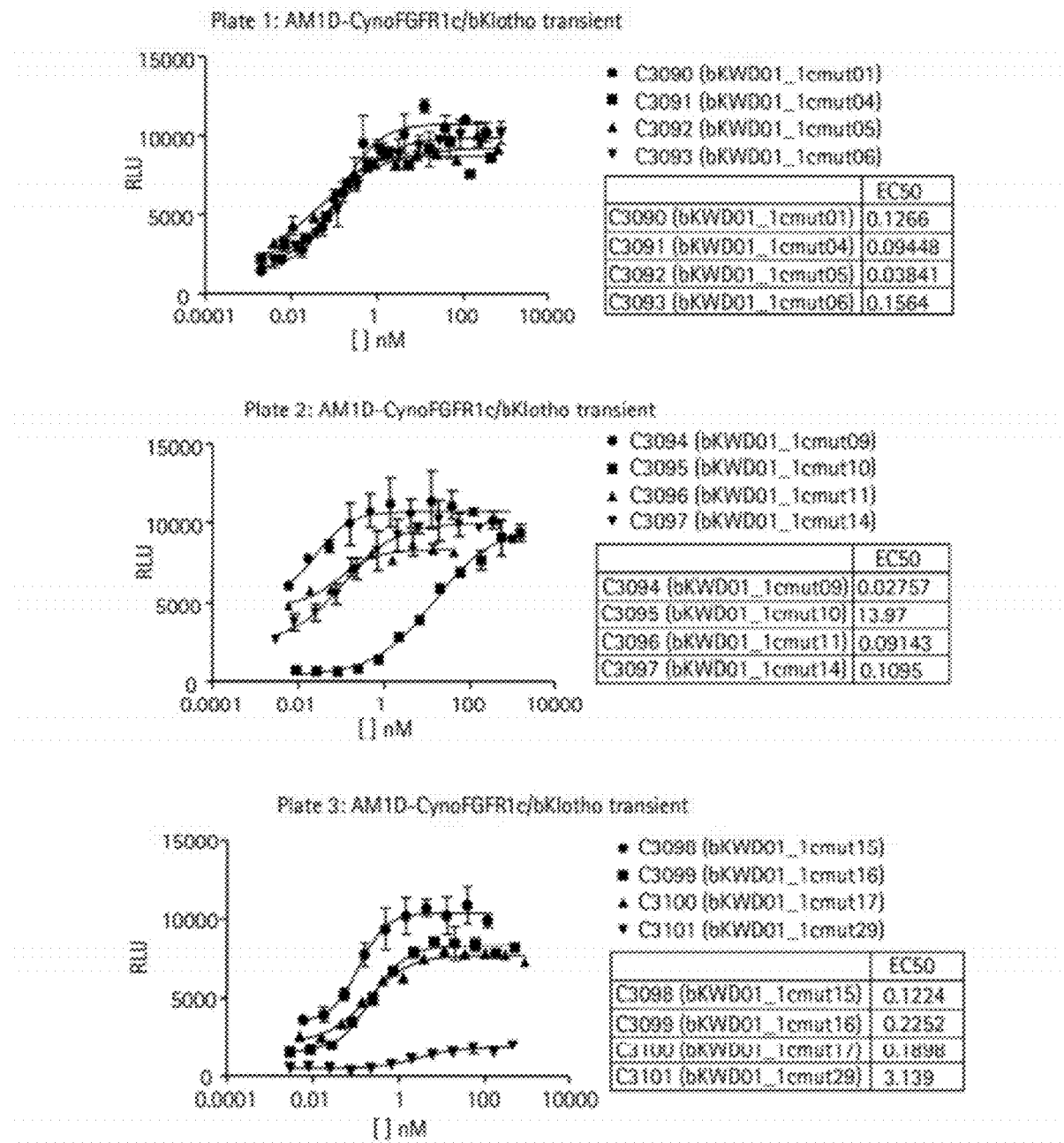
Figure 49B:
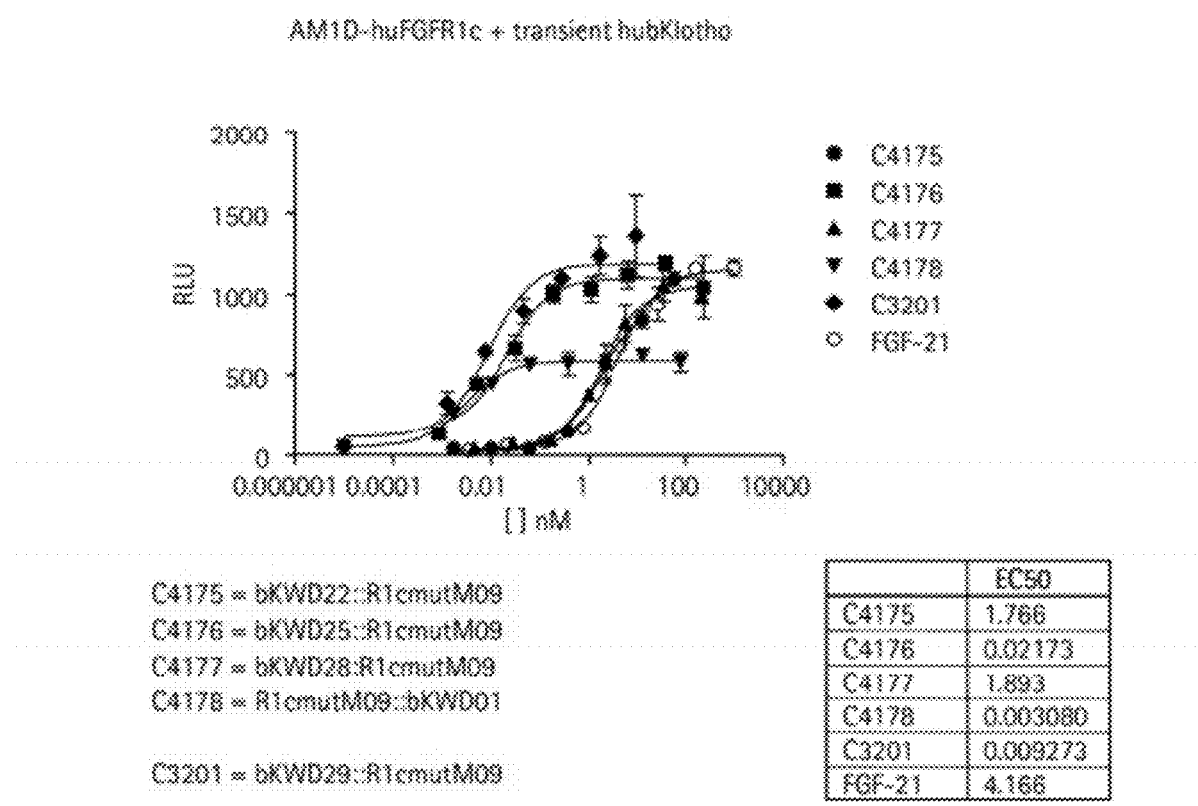

This example describes experiments allowing the identification of specific pairs of FGF receptor and klotho protein co-receptor that permit activation by FGF-21 or an FGF-21 mimetic molecule. An example of this data is shown in FIG. 37.

L6 cells were maintained in Dulbecco's modified Eagle's medium supplemented with 10% fetal bovine serum and penicillin/streptomycin. Cells were transfected with expression vectors using Lipofectamine 2000 transfection reagent (Invitrogen) according to the manufacturer's protocol. L6 cells plated in 24 well plates ($10^6$ cells/well) were transfected with various FGF receptors, including FGFR1b, 1c, 2b, 2c, 3b, 3c and FGFR4 and αKlotho or βKlotho and serum starved in 0.2% bovine serum albumin overnight before treatment with FGF-21 or an FGF-21 mimetic molecule. Media was aspirated after 10 min and plates were snap frozen in liquid nitrogen. Cells in each well were lysed in 60 µl of complete lysis buffer and total and phosphorylated ERK was measured using MSD whole cell lysate Phospho-ERK1/2 kit (Meso Scale Discovery, Gaithersburg, Md.) according to the manufacturer's instructions.

Example 11

This example describes experiments demonstrating induction of Erk phosphorylation in cultured human adipocytes in response to FGF-21 and FGF-21 mimetic molecules
Primary Human Adipocyte Cell Culture and Differentiation Cryopreserved subcutaneous human preadipocytes (Lot#SL0037) from Zen-Bio, Research Triangle Park, NC were stored in liquid nitrogen tank.

Cells were removed from liquid nitrogen and place immediately into a 37 degree water bath with agitation. The cells were added to a sterile conical bottom centrifuge tube containing 10 ml of Preadipocyte Medium per vial of cells (Zen-Bio, PM-1). The cells were centrifuged at 280×g, 20 degrees, 5 min. The medium was aspirated and the cells resuspended in PM-1.

Cells were counted and approximately $1.3 \times 10^6$ cells were plated in T-175 culture flasks in PM-1 medium. The cells were grown in humidified 37 degree incubator with 5% $CO_2$.

The cells were incubated until they were 85-90% confluent (about 3-4 days).

The medium was aspirated and preadipocytes were washed 2 times with sterile PBS. The PBS was removed and the cells released from the flask by adding 5 ml of 0.25% trypsin/2.21 mM EDTA solution. Cells were allowed to trypsinize for 5 minutes at 37 degrees. The trypsin was neutralized with 15 ml PM-1, spun, resuspended in PM-1 and count.

400,000 cells were plated per well in 3 ml PM-1 on Greiner Bio-One 6-well plates (VWR #82050-842) and grown in humidified 37 degree incubator with 5% CO2.

Once cells were completely confluent (24-48 hrs postplating), differentiation was induced by removing the entire volume of PM-1 from all wells and adding 3 ml of Adipocyte Differentiation Medium (Zen-Bio, DM-2). Cells were then incubated for 7 days at 37 degrees and 5% $CO_2$.

After 7 days, 1.8 ml of DM-2 was removed and 2.4 ml of Adipocyte Maintenance Medium (Zen-Bio, AM-1) was added. Every 2-3 days thereafter, 1.8 ml of AM-1 was removed and 1.8 ml fresh AM-1 was added. Day 14 of differentiation was the last exchange of AM-1.
Primary Human Adipocyte Treatment for pERK:

On Day 17 of differentiation, all medium was removed from wells and each well was washed twice with 2 ml of warm PBS. The adipocytes were serum starved for 3 hrs in adipocyte serum starvation medium comprised of 1:1 low glucose DMEM (Invitrogen, #11885) and F12 (Invitrogen, #11765) with 0.2% Fatty Acid-Free BSA (Sigma, A9205), 2 ml per well.

After 3 hr incubation, 1.4 ml medium was removed and the cells treated with the proper doses of binding protein for 10 minutes at 37 degrees (add 60 µL of 11× sample in starvation medium to each well). Recombinant FGF-21 was used as a positive control.

After 10 min treatment, medium was aspirated from wells and the cells washed twice with 2 ml cold PBS.
Lyse the cells in 175 ul/well of lysis buffer.
Lysis Buffer:
50 mM Tris-HCl, pH 7.4
150 mM NaCl
1% Nonidet P40
0.25% Sodium Deoxycholate
1 mM NaF
1 tablet complete protease inhibitor cocktail/50 ml (Roche, Indianapolis, Ind.)
0.7 µg/ml Pepstatin
1 mM $Na_3VO_4$
Protease inhibitor, $Na_3VO_4$, 1 mM NaF and pepstatin fresh were added before lysis.

The plate was snap frozen in liquid nitrogen and store at −80° C. until later use or proceed with lysate harvest.

Before harvesting the lysate, the plate was shaken for 20 min at 4° C. and the lysate transferred to 1.5 mL eppendorf tubes.

The lysates were spun at 15,000 rpm for 30 minutes at 4° C.

Lysates (undiluted) were quantitated with the DC Protein assay (Bio-Rad, Hercules, Calif., Cat#500-0116).

ERK Phospho/Total MSD Assay:

MSD (Meso-Scale Discovery, Gaithersburg, Md.) Phospho-, Total ERK1/2 Whole Cell Lysate kit (cat#K11107D-1, V2) was used to test human adipocyte lysates.

The protocol on the package insert included in the kit was followed. 25 ug of cell lysate was added to each well.

Once the assay finished, the % phosphoprotein was determined according to MSD formula:

% phosphoprotein=((2*pERK)/(pERK+Total ERK))*100

Figure 36:
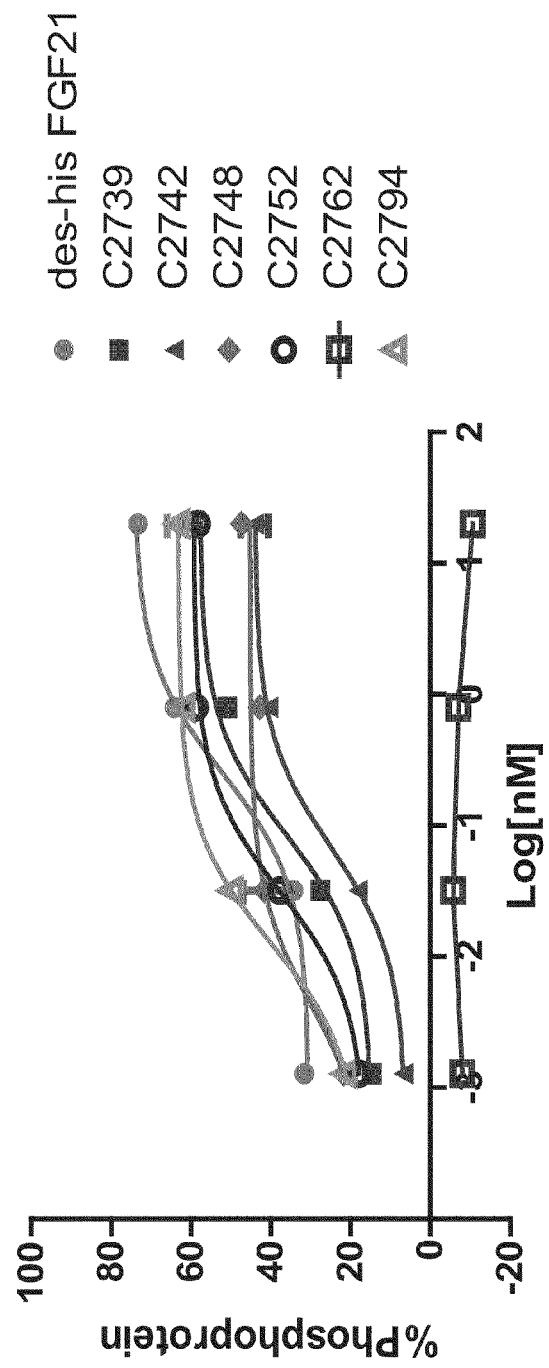
FIG. 36 is a plot generated using an adipocyte cell-based assay that demonstrates binding proteins C2739 (SEQ ID NO:372), C2742 (SEQ ID NO:375), C2748 (SEQ ID NO:380), C2752 (SEQ ID NO:384), C2794 (SEQ ID NO:390) induce FGF21-like signaling activity.

An example of this data is shown in FIG. 36.

Binding Proteins with Agonist Activity Similar to FGF-21 in In Vitro Cell-Based Assays The following summarizes the sequences of FGFR1c/βKlotho bispecific binding proteins that have been shown to have potency similar to, or exceeding that of native FGF-21. The efficacies of these binding proteins varies from 10% to 100% that of native FGF-21. The results of the assays are shown in FIGS. 38-45, 47-50. These proteins were shown to not activate signaling in the absence of β-Klotho (FIG. 46).

N-Terminal Monomer Listed First

```
bKWD01_R1cM03mut01 (C3090)
                                      (SEQ ID NO: 335)
    CLPDEFQCGSGRCIPQHWLCDGLNDCGDGSDEPPAHCSAPASEPPG
SLCRAGEFRCSNGRCVPLTWLCDGEDDCQDNSDEKNCAQPTCGAGLFTCR
STNICISQVWVCDGVDDCEDNSDEDSCSAPASEPPGSL;

bKWD01_R1cM03mut04 (C3091)
                                      (SEQ ID NO: 336)
    CLPDEFQCGSGRCIPQHWLCDGLNDCGDGSDEPPAHCSAPASEPPG
SLCRAGEFRCSNGRCVPLTWLCDGEDDCQDNSDEKNCAQPTCGAGLFTCR
STNICISQAWVCDGVDDCEDNSDENYCSAPASEPPGSL;

bKWD01_R1cM03mut05 (C3092)
                                      (SEQ ID NO: 337)
    CLPDEFQCGSGRCIPQHWLCDGLNDCGDGSDEPPAHCSAPASEPPG
SLCRAGEFRCSNGRCVPLTWLCDGEDDCQDNSDEKNCAQPTCGAGLFTCR
STNICISQAWVCDGVDDCEDNSDETNCSAPASEPPGSL;

bKWD01_R1cM03mut06 (C3093)
                                      (SEQ ID NO: 338)
    CLPDEFQCGSGRCIPQHWLCDGLNDCGDGSDEPPAHCSAPASEPPG
SLCRAGEFRCSNGRCVPLTWLCDGEDDCQDNSDEKNCAQPTCGASLFTCR
RSNICISQAWVCDGVDDCEDNSDEMNCSAPASEPPGSL;

bKWD01_R1cM03mut09 (C3094)
                                      (SEQ ID NO: 339)
    CLPDEFQCGSGRCIPQHWLCDGLNDCGDGSDEPPAHCSAPASEPPG
SLCRAGEFRCSNGRCVPLTWLCDGEDDCQDNSDEKNCAQPTCGEGLFTCR
STNICISHAWVCDGVDDCEDNSDENNCSAPASEPPGSL;

bKWD01_R1cM23mut10 (C3095)
                                      (SEQ ID NO: 340)
    CLPDEFQCGSGRCIPQHWLCDGLNDCGDGSDEPPAHCSAPASEPPG
SLCRAGEFRCSNGRCVPLTWLCDGEDDCQDNSDEKNCAQPTCGANLFTCQ
SSNICISDAWVCDGVDDCEDNSDETTCSQDPEFHKV;

bKWD01_R1cM23mut11 (C3096)
                                      (SEQ ID NO: 341)
    CLPDEFQCGSGRCIPQHWLCDGLNDCGDGSDEPPAHCSAPASEPPG
SLCRAGEFRCSNGRCVPLTWLCDGEDDCQDNSDEKNCAQPTCGANLFTCR
STNICISPAWVCDGVDDCEDYSDEIGCSQDPEFHKV;

bKWD01_R1cM23mut14 (C3097)
                                      (SEQ ID NO: 342)
    CLPDEFQCGSGRCIPQHWLCDGLNDCGDGSDEPPAHCSAPASEPPG
SLCRAGEFRCSNGRCVPLTWLCDGEDDCQDNSDEKNCAQPTCGSDMFTCR
STNICISKVWVCDGVDDCEDDSDERGCSQDPEFHKV;

bKWD01_R1cM23mut15 (C3098)
                                      (SEQ ID NO: 343)
    CLPDEFQCGSGRCIPQHWLCDGLNDCGDGSDEPPAHCSAPASEPPG
SLCRAGEFRCSNGRCVPLTWLCDGEDDCQDNSDEKNCAQPTCGSNLFTCR
RTNICISKAWVCDGVDDCEDNSDETGCSQDPEFHKV;

bKWD01_R1cM23mut16 (C3099)
                                      (SEQ ID NO: 344)
    CLPDEFQCGSGRCIPQHWLCDGLNDCGDGSDEPPAHCSAPASEPPG
SLCRAGEFRCSNGRCVPLTWLCDGEDDCQDNSDEKNCAQPTCGSNLFTCR
STNICISPAWVCDGVDDCDDDSDETGCSQDPEFHKV;

bKWD01_R1cM23mut17 (C3100)
                                      (SEQ ID NO: 345)
    CLPDEFQCGSGRCIPQHWLCDGLNDCGDGSDEPPAHCSAPASEPPG
SLCRAGEFRCSNGRCVPLTWLCDGEDDCQDNSDEKNCAQPTCGTNLFTCR
STNMCISQAWVCDGVDDCEDNSDETVCSQDPEFHKV;

bKWD03_R1cM15 (C3102)
                                      (SEQ ID NO: 346)
    CLPDEFQCGSGRCIPQTWVCDGLNDCGDGSDESPAHCSQDPEFHKV
CRPGEFRCNNGRCVPQTWVCDGEDDCGDNSDETDCSAPASEPPGSLCGAN
QFTCHNTNICISQAWVCDGVDDCEDNSDEKNCSAPASEPPGSL;

bKWD06_R1cM15 (C3103)
                                      (SEQ ID NO: 347)
    CLPDEFQCGSGRCIPQTWVCDGLNDCGDGSDESPAHCSQDPEFHKV
CQPNEFQCGNGRCIPAQWLCDGEDDCQDNSDEEDCTEHTCGANQFTCHNT
NICISQAWVCDGVDDCEDNSDEKNCSAPASEPPGSL;

bKWD22_R1cM15 (C3104)
                                      (SEQ ID NO: 348)
    CPADEFRCSNTGRCVPLSWLCDGEDDCGDGSDETNCKAHTCPSNQF
PCRSTGICIPLAWVCDGLNDCGDGSDESPATCKAPVPTCGANQFTCHNTN
ICISQAWVCDGVDDCEDNSDEKNCSAPASEPPGSL;

bKWD29_R1cM15 (C3105)
                                      (SEQ ID NO: 349)
    CGADQFRCGNGSCVPRAWRCDGVDDCGDGSDEAPEICETPTCQSNE
FRCRSGRCIPQHWLCDGLNDCGDGSDESQQCSAPASEPPGSLCGANQFTC
HNTNICISQAWVCDGVDDCEDNSDEKNCSAPASEPPGSL;

bKWD06_R1cM03mut06 (C3192)
                                      (SEQ ID NO: 350)
    CLPDEFQCGSGRCIPQTWVCDGLNDCGDGSDESPAHCSQDPEFHKV
CQPNEFQCGNGRCIPAQWLCDGEDDCQDNSDEEDCTEHTCGASLFTCRRS
NICISQAWVCDGVDDCEDNTDEMNCSAPASEPPGSL;
``` bKWD06_R1cM03mut09 (C3193)

(SEQ ID NO: 351)
CLPDEFQCGSGRCIPQTWVCDGLNDCGDGSDESPAHCSQDPEFHKV
CQPNEFQCGNGRCIPAQWLCDGEDDCQDNSDEEDCTEHTCGEGLFTCRST
NICISHAWVCDGVDDCEDNSDENNCSAPASEPPGSL;

bKWD06_R1cM03mut11 (C3194)

(SEQ ID NO: 352)
CLPDEFQCGSGRCIPQTWVCDGLNDCGDGSDESPAHCSQDPEFHKV
CQPNEFQCGNGRCIPAQWLCDGEDDCQDNSDEEDCTEHTCGANLFTCRST
NICISPAWVCDGVDDCEDYSDEIGCSQDPEFHKV;

bKWD06_R1cM03mut17 (C3195)

(SEQ ID NO: 353)
CLPDEFQCGSGRCIPQTWVCDGLNDCGDGSDESPAHCSQDPEFHKV
CQPNEFQCGNGRCIPAQWLCDGEDDCQDNSDEEDCTEHTCGTNLFTCRST
NMCISQAWVCDGVDDCEDNSDETVCSQDPEFHKV;

bKWD22_R1cM03mut06 (C3196)

(SEQ ID NO: 354)
CPADEFRCSNTGRCVPLSWLCDGEDDCGDGSDETNCKAHTCPSNQF
PCRSTGICIPLAWVCDGLNDCGDGSDESPATCKAPVPTCGASLFTCRRSN
ICISQAWVCDGVDDCEDNSDEMNCSAPASEPPGSL;

bKWD22_R1cM03mut09 (C3197)

(SEQ ID NO: 355)
CPADEFRCSNTGRCVPLSWLCDGEDDCGDGSDETNCKAHTCPSNQF
PCRSTGICIPLAWVCDGLNDCGDGSDESPATCKAPVPTCGEGLFTCRSTN
ICISHAWVCDGVDDCEDNSDENNCSAPASEPPGSL;

bKWD22_R1cM03mut11 (C3198)

(SEQ ID NO: 356)
CPADEFRCSNTGRCVPLSWLCDGEDDCGDGSDETNCKAHTCPSNQF
PCRSTGICIPLAWVCDGLNDCGDGSDESPATCKAPVPTCGANLFTCRSTN
ICISPAWVCDGVDDCEDYSDEIGCSQDPEFHKV;

bKWD22_R1cM03mut17 (C3199)

(SEQ ID NO: 357)
CPADEFRCSNTGRCVPLSWLCDGEDDCGDGSDETNCKAHTCPSNQF
PCRSTGICIPLAWVCDGLNDCGDGSDESPATCKAPVPTCGTNLFTCRSTN
MCISQAWVCDGVDDCEDNSDETVCSQDPEFHKV;

bKWD29_R1cM03mut06 (C3200)

(SEQ ID NO: 358)
CGADQFRCGNGSCVPRAWRCDGVDDCGDGSDEAPEICETPTCQSNE
FRCRSGRCIPQHWLCDGLNDCGDGSDESQQCSAPASEPPGSLCGASLFTC
RRSNICISQAWVCDGVDDCEDNSDEMNCSAPASEPPGSL;

bKWD29_R1cM03mut09 (C3201)

(SEQ ID NO: 359)
CGADQFRCGNGSCVPRAWRCDGVDDCGDGSDEAPEICETPTCQSNE
FRCRSGRCIPQHWLCDGLNDCGDGSDESQQCSAPASEPPGSLCGEGLFTC
RSTNICISHAWVCDGVDDCEDNSDENNCSAPASEPPGSL;

bKWD29_R1cM03mut11 (C3202)

(SEQ ID NO: 360)
CGADQFRCGNGSCVPRAWRCDGVDDCGDGSDEAPEICETPTCQSNE
FRCRSGRCIPQHWLCDGLNDCGDGSDESQQCSAPASEPPGSLCGANLFTC
RSTNICISPAWVCDGVDDCEDYSDEIGCSQDPEFHKV;

bKWD29_R1cM03mut17 (C3203)

(SEQ ID NO: 361)
CGADQFRCGNGSCVPRAWRCDGVDDCGDGSDEAPEICETPTCQSNE
FRCRSGRCIPQHWLCDGLNDCGDGSDESQQCSAPASEPPGSLCGTNLFTC
RSTNMCISQAWVCDGVDDCEDNSDETVCSQDPEFHKV;

R1cM03mut06_bKWD22 (C3204)

(SEQ ID NO: 362)
CGASLFTCRRSNICISQAWVCDGVDDCEDNSDEMNCSAPASEPPGS
LCPADEFRCSNTGRCVPLSWLCDGEDDCGDGSDETNCKAHTCPSNQFPCR
STGICIPLAWVCDGLNDCGDGSDESPATCKAPVPT;

R1cM03mut09_bKWD22 (C3205)

(SEQ ID NO: 363)
CGEGLFTCRSTNICISHAWVCDGVDDCEDNSDENNCSAPASEPPGS
LCPADEFRCSNTGRCVPLSWLCDGEDDCGDGSDETNCKAHTCPSNQFPCR
STGICIPLAWVCDGLNDCGDGSDESPATCKAPVPT;

R1cM03mut11_bKWD22 (C3206)

(SEQ ID NO: 364)
CGANLFTCRSTNICISPAWVCDGVDDCEDYSDEIGCSQDPEFHKVC
PADEFRCSNTGRCVPLSWLCDGEDDCGDGSDETNCKAHTCPSNQFPCRST
GICIPLAWVCDGLNDCGDGSDESPATCKAPVPT;

R1cM03mut17_bKWD22 (C3207)

(SEQ ID NO: 365)
CGTNLFTCRSTNMCISQAWVCDGVDDCEDNSDETVCSQDPEFHKVC
PADEFRCSNTGRCVPLSWLCDGEDDCGDGSDETNCKAHTCPSNQFPCRST
GICIPLAWVCDGLNDCGDGSDESPATCKAPVPT;

R1cM03mut06_bKWD29 (C3208)

(SEQ ID NO: 366)
CGASLFTCRRSNICISQAWVCDGVDDCEDNSDEMNCSAPASEPPGS
LCGADQFRCGNGSCVPRAWRCDGVDDCGDGSDEAPEICETPTCQSNEFRC
RSGRCIPQHWLCDGLNDCGDGSDESQQCSAPASEPPGSL;

R1cM03mut09_bKWD29 (C3209)

(SEQ ID NO: 367)
CGEGLFTCRSTNICISHAWVCDGVDDCEDNSDENNCSAPASEPPGS
LCGADQFRCGNGSCVPRAWRCDGVDDCGDGSDEAPEICETPTCQSNEFRC
RSGRCIPQHWLCDGLNDCGDGSDESQQCSAPASEPPGSL;

R1cM03mut11_bKWD29 (C3210)

(SEQ ID NO: 368)
CGANLFTCRSTNICISPAWVCDGVDDCEDYSDEIGCSQDPEFHKVC
GADQFRCGNGSCVPRAWRCDGVDDCGDGSDEAPEICETPTCQSNEFRCRS
GRCIPQHWLCDGLNDCGDGSDESQQCSAPASEPPGSL;

R1cM03mut17_bKWD29 (C3211)

(SEQ ID NO: 369)
CGTNLFTCRSTNMCISQAWVCDGVDDCEDNSDETVCSQDPEFHKVC
GADQFRCGNGSCVPRAWRCDGVDDCGDGPDEAPEICETPTCQSNEFRCRS
GRCIPQHWLCDGLNDCGDGSDESQQCSAPASEPPGSL;

R1cM03_BKWD01 (C2737)

(SEQ ID NO: 370)
CGAGLFTCRSTKICISQAWVCDGVDDCEDNSDEKNCSAPASEPPGS
LCLPDEFQCGSGRCIPQHWLCDGLNDCGDGSDEPPAHCSAPASEPPGSLC
RAGEFRCSNGRCVPLTWLCDGEDDCQDNSDEKNCAQPT;

R1cM03_BKWD02 (C2738)

(SEQ ID NO: 371)
CGAGLFTCRSTKICISQAWVCDGVDDCEDNSDEKNCSAPASEPPGS
LCLPDEFQCSSGRCIPQTWVCDGLNDCGDGSDESPAHCSQDPEFHKVCPS
SEFRCNNGRCIPLHWVCDGDDDCQDNSDETDCERSGRT;

BKWD02_R1cM03 (C2739)

(SEQ ID NO: 372)
CLPDEFQCSSGRCIPQTWVCDGLNDCGDGSDESPAHCSQDPEFHKV
CPSSEFRCNNGRCIPLHWVCDGDDDCQDNSDETDCERSGRTCGAGLFTCR
STKICISQAWVCDGVDDCEDNSDEKNCSAPASEPPGSL;

R1cM03_BKWD25 (C2740)

(SEQ ID NO: 373)
CGAGLFTCRSTKICISQAWVCDGVDDCEDNSDEKNCSAPASEPPGS
LCGPDEFRCNNGQCIPLPWRCDGVDDCGDNSDEPLEICQAPTCQSNEFRC
RSGRCIPQHWLCDGLNDCGDGSDEPPAHCSAPASEPPGSL;

R1cM08_BKWD01 (C2741)

(SEQ ID NO: 374)
CGAGQFTCRDTNICISRAWRCDGVDDCEDNSDEADCSQDPEFHKVC
LPDEFQCGSGRCIPQHWLCDGLNDCGDGSDEPPAHCSAPASEPPGSLCRA
GEFRCSNGRCVPLTWLCDGEDDCQDNSDEKNCAQPT;

BKWD01_R1cM08 (C2742)

(SEQ ID NO: 375)
CLPDEFQCGSGRCIPQHWLCDGLNDCGDGSDEPPAHCSAPASEPPG
SLCRAGEFRCSNGRCVPLTWLCDGEDDCQDNSDEKNCAQPTCGAGQFTCR
DTNICISRAWRCDGVDDCEDNSDEADCSQDPEFHKV;

R1cM08_BKWD02 (C2743)

(SEQ ID NO: 376)
CGAGQFTCRDTNICISRAWRCDGVDDCEDNSDEADCSQDPEFHKVC
LPDEFQCSSGRCIPQTWVCDGLNDCGDGSDESPAHCSQDPEFHKVCPSSE
FRCNNGRCIPLHWVCDGDDDCQDNSDETDCERSGRT;

BKWD02_R1cM08 (C2744)

(SEQ ID NO: 377)
CLPDEFQCSSGRCIPQTWVCDGLNDCGDGSDESPAHCSQDPEFHKV
CPSSEFRCNNGRCIPLHWVCDGDDDCQDNSDETDCERSGRTCGAGQFTCR
DTNICISRAWRCDGVDDCEDNSDEADCSQDPEFHKV;

R1cM08_BKWD25 (C2745)

(SEQ ID NO: 378)
CGAGQFTCRDTNICISRAWRCDGVDDCEDNSDEADCSQDPEFHKVC
GPDEFRCNNGQCIPLPWRCDGVDDCGDNSDEPLEICQAPTCQSNEFRCRS
GRCIPQHWLCDGLNDCGDGSDEPPAHCSAPASEPPGSL;

R1cM15_BKWD01 (C2747)

(SEQ ID NO: 379)
CGANQFTCHNTNICISQAWVCDGVDDCEDNSDEKNCSAPASEPPGS
LCLPDEFQCGSGRCIPQHWLCDGLNDCGDGSDEPPAHCSAPASEPPGSLC
RAGEFRCSNGRCVPLTWLCDGEDDCQDNSDEKNCAQPT;

R1cM31_BKWD25 (C2748)

(SEQ ID NO: 380)
CLSDQFTCRSTNICLPLQWVCDGDDDCEDNSDEEDCSAPASEPPGS
LCGPDEFRCNNGQCIPLPWRCDGVDDCGDNSDEPLEICQAPTCQSNEFRC
RSGRCIPQHWLCDGLNDCGDGSDEPPAHCSAPASEPPGSL;

R1cM15_BKWD02 (C2749)

(SEQ ID NO: 381)
CGANQFTCHNTNICISQAWVCDGVDDCEDNSDEKNCSAPASEPPGS
LCLPDEFQCSSGRCIPQTWVCDGLNDCGDGSDESPAHCSQDPEFHKVCPS
SEFRCNNGRCIPLHWVCDGDDDCQDNSDETDCERSGRT;

BKWD02_R1cM15 (C2750)

(SEQ ID NO: 382)
CLPDEFQCSSGRCIPQTWVCDGLNDCGDGSDESPAHCSQDPEFHKV
CPSSEFRCNNGRCIPLHWVCDGDDDCQDNSDETDCERSGRTCGANQFTCH
NTNICISQAWVCDGVDDCEDNSDEKNCSAPASEPPGSL;

R1cM15_BKWD25 (C2751)

(SEQ ID NO: 383)
CGANQFTCHNTNICISQAWVCDGVDDCEDNSDEKNCSAPASEPPGS
LCGPDEFRCNNGQCIPLPWRCDGVDDCGDNSDEPLEICQAPTCQSNEFRC
RSGRCIPQHWLCDGLNDCGDGSDEPPAHCSAPASEPPGSL;

BKWD01_R1cM23 (C2752)

(SEQ ID NO: 384)
CLPDEFQCGSGRCIPQHWLCDGLNDCGDGSDEPPAHCSAPASEPPG
SLCRAGEFRCSNGRCVPLTWLCDGEDDCQDNSDEKNCAQPTCGSNQFTCR
STNICISQAWVCDGVDDCEDDSDETGCSQDPEFHKV;

R1cM23_BKWD02 (C2753)

(SEQ ID NO: 385)
CGSNQFTCRSTNICISQAWVCDGVDDCEDDSDETGCSQDPEFHKVC
LPDEFQCSSGRCIPQTWVCDGLNDCGDGSDESPAHCSQDPEFHKVCPSSE
FRCNNGRCIPLHWVCDGDDDCQDNSDETDCERSGRT;

BKWD02_R1cM23 (C2754)

(SEQ ID NO: 386)
CLPDEFQCSSGRCIPQTWVCDGLNDCGDGSDESPAHCSQDPEFHKV
CPSSEFRCNNGRCIPLHWVCDGDDDCQDNSDETDCERSGRTCGSNQFTCR
STNICISQAWVCDGVDDCEDDSDETGCSQDPEFHKV;

BKWD01_R1cM31 (C2757)

(SEQ ID NO: 387)
CLPDEFQCGSGRCIPQHWLCDGLNDCGDGSDEPPAHCSAPASEPPG
SLCRAGEFRCSNGRCVPLTWLCDGEDDCQDNSDEKNCAQPTCLSDQFTCR
STNICLPLQWVCDGDDDCEDNSDEEDCSAPASEPPGSL;

BKWD05_R1cM08 (C2792)

(SEQ ID NO: 388)
CAAGQFRCHNSDTCLPGAWVCDGDNDCGDNSDEASCQKRTCHSFNQ
FECRNGQCIPLHLVCDGVPDCGDNSDETDCGDSHILPFSTPGPSTCGAGQ
FTCRDTNICISRAWRCDGVDDCEDNSDEADCSQDPEFHKV;

BKWD06_R1cM08 (C2793)

(SEQ ID NO: 389)
CAPDQFRCSSGQCIPETWLCDGDDDCVDSSDEAGCASTVPTCLPDE
FQCGSGRCIPQTWVCDGLNDCGDGSDESPAHCSQDPEFHKVCGAGQFTCR
DTNICISRAWRCDGVDDCEDNSDEADCSQDPEFHKV;

BKWD01_R1cM15 (C2794)

(SEQ ID NO: 390)
CLPDEFQCGSGRCIPQHWLCDGLNDCGDGSDEPPAHCSAPASEPPG
SLCRAGEFRCSNGRCVPLTWLCDGEDDCQDNSDEKNCAQPTCGANQFTCH
NTNICISQAWVCDGVDDCEDNSDEKNCSAPASEPPGSL;

```
R1cM15_BKWD31 (C2795)
                                      (SEQ ID NO: 391)
     CGANQFTCHNTNICISQAWVCDGVDDCEDNSDEKNCSAPASEPPGS

LCLPDEFRCGNGNCISVAWRCDGVDDCEDGSDEEDCESPEHTCQSNEFRC

RSGRCIPQHWLCDGLNDCGDGSDESPAHCSQDPEFHKV;
and

R1cM15_BKWD06 (C2796)
                                      (SEQ ID NO: 392)
     CGANQFTCHNTNICISQAWVCDGVDDCEDNSDEKNCSAPASEPPGS

LCAPDQFRCSSGQCIPETWLCDGDDDCVDSSDEAGCASTVPTCLPDEFQC

GSGRCIPQTWVCDGNDCGDGSDESPAHCSQDPEFHKV.

bKWD02_R1cM03mutM09 (C4168)
                                     (SEQ ID NO: 1265)
     CLPDEFQCSSGRCIPQTWVCDGLNDCGDGSDESPAHCSQDPEFHKV

CPSSEFRCNNGRCIPLHWVCDGDDDCQDNSDETDCAQPTCGEGLFTCRST

NICISHAWVCDGVDDCEDNSDENNCSAPASEPPGSL bKWD03_R1cM03mutM09 (C4169)
                                     (SEQ ID NO: 1266)
     CLPDEFQCGSGRCIPQTWVCDGLNDCGDGSDESPAHCSQDPEFHKV

CRPGEFRCNNGRCVPQTWVCDGEDDCGDNSDETDCAQPTCGEGLFTCRST

NICISHAWVCDGVDDCEDNSDENNCSAPASEPPGSL bKWD04_R1cM03mutM09 (C4170)
                                     (SEQ ID NO: 1267)

CLPDEFQCGSGRCIPQTWVCDGLNDCGDGSDESPAHCSQDPEFHKV

CLSDQFRCGNGRCVPRAWLCDGDNDCQDGSDETNCEQPTCGEGLFTCRST

NICISHAWVCDGVDDCEDNSDENNCSAPASEPPGSL bKWD05_R1cM03mutM09 (C4171)
                                     (SEQ ID NO: 1268)
     CLPDEFQCGSGRCIPQTWVCDGLNDCGDGSDESPAHCSQDPEFHKV

CLPGQFPCGNGRCIPETWLCDGDDDCQDGSDEKGCAQPTCGEGLFTCRST

NICISHAWVCDGVDDCEDNSDENNCSAPASEPPGSL bKWD08_R1cM03mutM09 (C4173)
                                     (SEQ ID NO: 1269)
     CLPDEFQCGSGRCIPQTWVCDGLNDCGDGSDESPAHCSQDPEFHKV

CQSNEFRCRNGQCIPLTWLCDGDNDCLDSSDEESCPAHTCGEGLFTCRST

NICISHAWVCDGVDDCEDNSDENNCSAPASEPPGSL bKWD21_R1cM03 mutM09 (C4174)
                                     (SEQ ID NO: 1270)
     CAPGEFTCKNTGRCIPLNWRCDGDDDCGDGSDETDCPAPTCPSNQF

PCRSTGICIPLAWVCDGLNDCGDGSDESPAHCSAPASEPPGSLCGEGLFT

CRSTNICISHAWVCDGVDDCEDNSDENNCSAPASEPPGSL bKWD25_R1cM03mutM09 (C4176)
                                     (SEQ ID NO: 1271)
     CGPDEFRCNNGQCIPLPWRCDGVDDCGDNSDEPLEICQAPTCQSNE

FRCRSGRCIPQHWLCDGLNDCGDGSDEPPAHCSAPASEPPGSLCGEGLFT

CRSTNICISHAWVCDGVDDCEDNSDENNCSAPASEPPGSL bKWD28_R1cM03mutM09 (C4177)
                                     (SEQ ID NO: 1272)
     CGANEFQCRSTGICVPVEWVCDGDNDCGDGSDEPPVCGDSHILPFS

TPGPSTCQPDEFTCSSGRCIPQPWLCDGLNDCGDGSDEPPAHCSAPASEP

PGSLCGEGLFTCRSTNICISHAWVCDGVDDCEDNSDENNCSAPASEPPGS

L

R1cM03mutM09_bKWD01 (C4178)
                                     (SEQ ID NO: 1273)
     CGEGLFTCRSTNICISHAWVCDGVDDCEDNSDENNCSAPASEPPGS

LCLPDEFQCGSGRCIPQHWLCDGLNDCGDGSDEPPAHCSAPASEPPGSLC

RAGEFRCSNGRCVPLTWLCDGEDDCQDNSDEKNCAQPT

LNRM01_R1cM03mutM09 (C4311)
                                     (SEQ ID NO: 1274)
     CIAAKLCEALDGDGVCHKECDLEECDWDGGDCQRIFLTDPTCGEGL

FTCRSTNICISHAWVCDGVDDCEDNSDENNCSAPASEPPGSL

R1cM03mutM09_LNRM01 (C4312)
                                     (SEQ ID NO: 1275)
     CGEGLFTCRSTNICISHAWVCDGVDDCEDNSDENNCSAPASEPPGS

LCIAAKLCEALDGDGVCHKECDLEECDWDGGDCQRIFLTDPT
```

Example 12

This example describes methods for extending the half-life of binding proteins in vivo.

A. IgG Binders and Serum Half-Life Extension

The instant disclosure further provides monomer domains that bind to (e.g., selectively bind) a blood factor (e.g., serum albumin, immunoglobulin, or erythrocytes). In some embodiments, the monomers disclosed herein will bind to a blood factor with an affinity of less than $10^{-3}$ M (i.e., binds stronger than an affinity of $10^{-3}$ M). In some embodiments, the affinity is less than $10^{-4}$ M, $10^{-5}$ M, $10^{-6}$ M, $10^{-7}$ M, or $10^{-8}$ M.

In some embodiments, the monomer domains bind to an immunoglobulin polypeptide or a portion thereof.

In some embodiments, the monomer domains bind to human serum albumin or a portion thereof.

Two families (i.e., A domain IgG Families 2 and 3) of monomer domains that bind to immunoglobulin have been identified.

IgG Family 2 comprises the following consensus motif (SEQ ID NO: 698):

[EQ]FXCRX[ST]XRC[IV]XXXW[ILV]CDGXXDCXD[DN]SDE

Exemplary sequences comprising the IgG Family 2 motif are displayed herein. References to IgG binding monomers or multimers encompass each Family 2 sequence exemplified in the examples.

IgG Family 3 comprises either of the two following consensus motifs (SEQ ID NOS 699-700, respectively, in order of appearance):

```
CXSSGRCIPXXWVCDGXXDCRDXSDE;    (SEQ ID NO: 699)
or
CXSSGRCIPXXWLCDGXXDCRDXSDE.    (SEQ ID NO: 700)
```

Exemplary sequences comprising the IgG Family 3 motif are displayed in the examples. References to IgG binding monomers or multimers encompass each Family 3 sequence exemplified in the examples.

Monomer domains that bind to red blood cells (RBC) or serum albumin (CSA) are described in U.S. Patent Publication No. 2005/0048512, and include, e.g. SEQ ID NOS:701-704:

RBCA
(SEQ ID NO: 701)
CRSSQFQCNDSRICIPGRWRCDGDNDCQDGSDETGCGDSHILPFSTPG
PST

RBCB
(SEQ ID NO: 702)
CPAGEFPCKNGQCLPVTWLCDGVNDCLDGSDEKGCGRPGPGATSAPAA

RBC11
(SEQ ID NO: 703)
CPPDEFPCKNGQCIPQDWLCDGVNDCLDGSDEKDCGRPGPGATSAPAA

CSA-A8
(SEQ ID NO: 704)
CGAGQFPCKNGHCLPLNLLCDGVNDCEDNSDEPSELCKALT

Also provided herein is a method for extending the serum half-life of a protein, including, e.g., a multimer disclosed herein or a protein of interest in an animal. The protein of interest can be any protein with therapeutic, prophylactic, or otherwise desirable functionality. This method comprises first providing a monomer domain that has been identified as a binding protein that specifically binds to a half-life extender such as a blood-carried molecule or cell, such as serum albumin (e.g., human serum albumin), IgG, red blood cells, etc. The half-life extender-binding monomer is then covalently linked to another monomer domain that has a binding affinity for the protein of interest (e.g., FGFR1c or a different target). This complex formation results in the half-life extension protecting the multimer and/or bound protein(s) from proteolytic degradation and/or other removal of the multimer and/or protein(s) and thereby extending the half-life of the protein and/or multimer. One variation of this use includes the half-life extender-binding monomer covalently linked to a protein of interest. The protein of interest can include a monomer domain, a multimer of monomer domains, or a synthetic drug. Alternatively, monomers that bind to either immunoglobulins or erythrocytes could be generated using the above method and could be used for half-life extension.

The half-life extender-binding multimers are typically multimers of at least two domains, chimeric domains, or mutagenized domains (i.e., one that binds to FGFR1c and/or β-Klotho and one that binds to the blood-carried molecule or cell). Suitable domains include all of those described herein, that are further screened and selected for binding to a half-life extender. The half-life extender-binding multimers are generated in accordance with the methods for making multimers described herein, using, for example, monomer domains pre-screened for half-life extender-binding activity. The serum half-life of a molecule can be extended to be, e.g., at least 1, 2, 3, 4, 5, 10, 20, 30, 40, 50, 60, 70 80, 90, 100, 150, 200, 250, 400, 500 or more hours.

A half-life extending monomer domain, such as a monomer that binds to IgG or HSA, can be linked to the N-, C-terminus or both the N- and C-termini of a target molecule (e.g., a FGFR1c/βKlotho binding protein). Exemplary sequences of binding proteins that bind to FGFR1c, βKlotho and IgG include the following (SEQ ID NOS 705-710, respectively, in order of appearance):

(SEQ ID NO: 705)
CLPDEFQCGSGRCIPQHWLCDGLNDCGDGSDEPPAHCSAPASEPPGSL
CRAGEFRCSNGRCVPLTWLCDGEDDCQDNSDEKNCAQPTCGANQFTCH
NTNICISQAWVCDGVDDCEDNSDEKNCSAPASEPPGSLCHPTGQFRCR
SSGRCVSPTWVCDGDRDCWDGSDEDNCSAPASEPPGSL (SEQ ID NO: 706)
CHPTGQFRCRSSGRCVSPTWVCDGDRDCWDGSDEDNCSAPASEPPGSL
CLPDEFQCGSGRCIPQHWLCDGLNDCGDGSDEPPAHCSAPASEPPGSL
CRAGEFRCSNGRCVPLTWLCDGEDDCQDNSDEKNCAQPTCGANQFTCH
NTNICISQAWVCDGVDDCEDNSDEKNCSAPASEPPGSL (SEQ ID NO: 707)
CGADQFRCGNGSCVPRAWRCDGVDDCGDGSDEAPEICETPTCQSNEFR
CRSGRCIPQHWLCDGLNDCGDGSDESQQCSAPASEPPGSLCGEGLFTC
RSTNICISHAWVCDGVDDCEDNSDENNCSAPASEPPGSLCHPTGQFRC
RSSGRCVSPTWVCDGDRDCWDGSDEDNCSAPASEPPGSLSLQ (SEQ ID NO: 708)
CGADQFRCGNGSCVPRAWRCDGVDDCGDGSDEAPEICETPTCQSNEFR
CRSGRCIPQHWLCDGLNDCGDGSDESQQCSAPASEPPGSLCGTNLFTC
RSTNMCISQAWVCDGVDDCEDNSDETVCSQDPEFHRVCHPTGQFRCRS
SGRCVSPTWVCDGDRDCWDGSDEDNCSAPASEPPGSLSLQ (SEQ ID NO: 709)
CHPTGQFRCRSSGRCVSPTWVCDGDRDCWDGSDEDNCSAPASEPPGSL
CGADQFRCGNGSCVPRAWRCDGVDDCGDGSDEAPEICETPTCQSNEFR
CRSGRCIPQHWLCDGLNDCGDGSDESQQCSAPASEPPGSLCGEGLFTC
RSTNICISHAWVCDGVDDCEDNSDENNCSAPASEPPGSLSLQ (SEQ ID NO: 710)
CHPTGQFRCRSSGRCVSPTWVCDGDRDCWDGSDEDNCSAPASEPPGSL
CGADQFRCGNGSCVPRAWRCDGVDDCGDGSDEAPEICETPTCQSNEFR
CRSGRCIPQHWLCDGLNDCGDGSDESQQCSAPASEPPGSLCGTNLFTC
RSTNMCISQAWVCDGVDDCEDNSDETVCSQDPEFHRVSLQ

B. Human Serum Albumin Fusions

In some embodiments binding protein domains are fused to either the N- or C-terminus of human serum albumin. This confers human serum albumin-like half life on the binding protein by targeting the binding protein (as part of the binding protein-human serum albumin polypeptide) to the FcRn scavenger pathway. Additionally, the increase in mass prevents loss of the intact binding protein-human serum albumin from serum by kidney filtration.

Binding protein-human serum albumin fusions can be expressed in yeast or mammalian cells.

Figure 51:
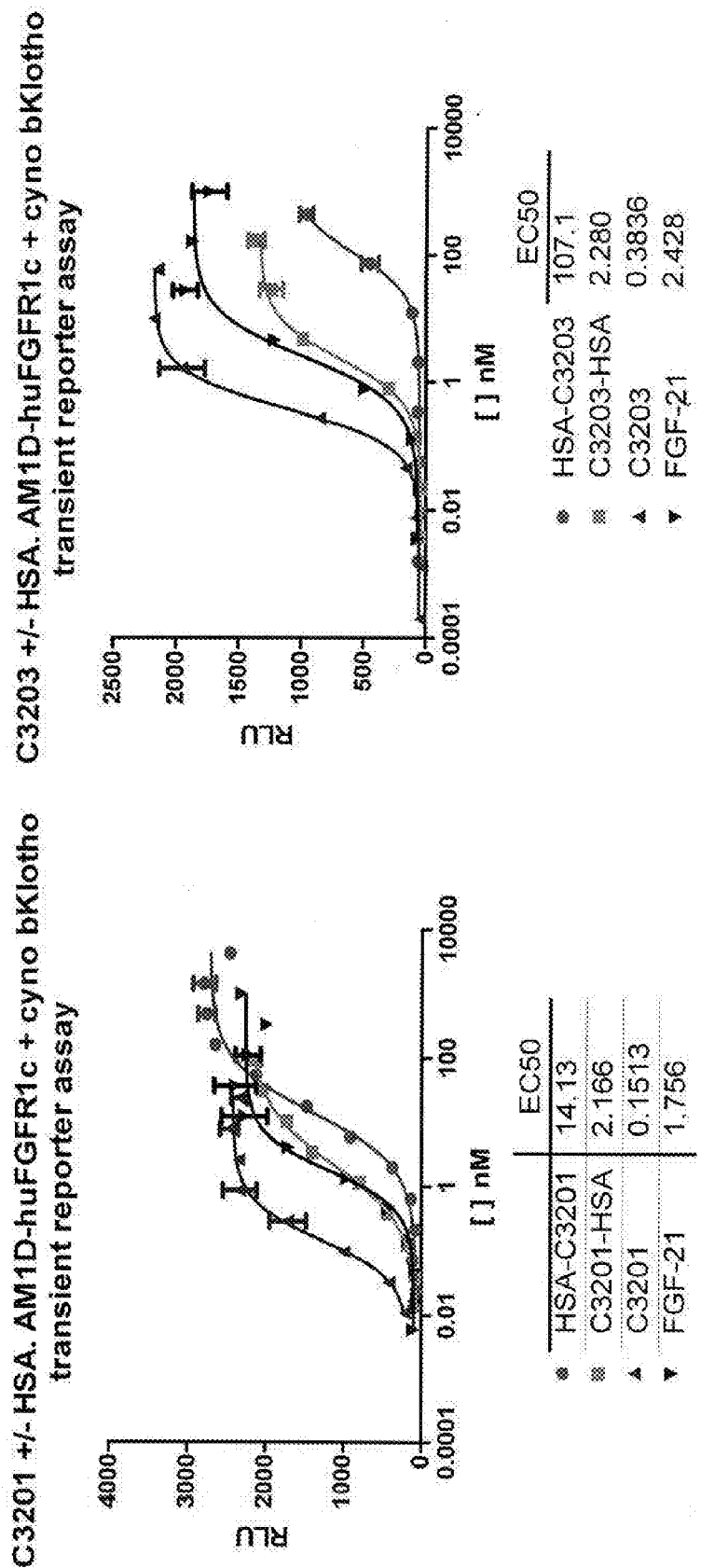
FIG. 51 is a series of plots generated using cells that express cynomolgus FGFR1c and cynomolgus β-Klotho, and demonstrate that binding proteins C3201-HSA (SEQ ID NO:713), C3203-HSA (SEQ ID NO:714), HSA-C3201 (SEQ ID NO:711) and HSA-C3203 (SEQ ID NO:712) are able to induce FGF21-like signaling.

A FGFR1c/βKlotho binding protein can be linked to the N- or C-terminus of human serum albumin. The binding protein sequence can be linked directly to the human serum albumin coding sequence, or via an intermediate linking sequence. In this context the binding protein still functions as an agonist, able to induce FGF21-like signaling in a reporter cell assay (see, e.g. FIGS. 51-53). Exemplary sequences of such polypeptides include the following:

HSA-C3201
(SEQ ID NO: 711)
DAHKSEVAHRFKDLGEENFKALVLIAFAQYLQQCPFEDHVKLVNEVTE
FAKTCVADESAENCDKSLHTLFGDKLCTVATLRETYGEMADCCAKQEP
ERNECFLQHKDDNPNLPRLVRPEVDVMCTAFHDNEETFLKKYLYEIAR
RHPYFYAPELLFFAKRYKAAFTECCQAADKAACLLPKLDELRDEGKAS
SAKQRLKCASLQKFGERAFKAWAVARLSQRFPKAEFAEVSKLVTDLTK
VHTECCHGDLLECADDRADLAKYICENQDSISSKLKECCEKPLLEKSH
CIAEVENDEMPADLPSLAADFVESKDVCKNYAEAKDVFLGMFLYEYAR
RHPDYSVVLLLRLAKTYETTLEKCCAAADPHECYAKVFDEFKPLVEEP
QNLIKQNCELFEQLGEYKFQNALLVRYTKKVPQVSTPTLVEVSRNLGK
VGSKCCKHPEAKRMPCAEDYLSVVLNQLCVLHEKTPVSDRVTKCCTES
LVNRRPCFSALEVDETYVPKEFNAETFTFHADICTLSEKERQIKKQTA
LVELVKHKPKATKEQLKAVMDDFAAFVEKCCKADDKETCFAEEGKKLV
AASQAALGLGGGGSGGGGSCGADQFRCGNGSCVPRAWRCDGVDDCGDG

-continued

SDEAPEICETPTCQSNEFRCRSGRCIPQHWLCDGLNDCGDGSDESQQC
SAPASEPPGSLCGEGLFTCRSTNICISHAWVCDGVDDCEDNSDENNCS
APASEPPGSL

HSA-C3203
(SEQ ID NO: 712)
DAHKSEVAHRFKDLGEENFKALVLIAFAQYLQQCPFEDHVKLVNEVTE
FAKTCVADESAENCDKSLHTLFGDKLCTVATLRETYGEMADCCAKQEP
ERNECFLQHKDDNPNLPRLVRPEVDVMCTAFHDNEETFLKKYLYEIAR
RHPYFYAPELLFFAKRYKAAFTECCQAADKAACLLPKLDELRDEGKAS
SAKQRLKCASLQKFGERAFKAWAVARLSQRFPKAEFAEVSKLVTDLTK
VHTECCHGDLLECADDRADLAKYICENQDSISSKLKECCEKPLLEKSH
CIAEVENDEMPADLPSLAADFVESKDVCKNYAEAKDVFLGMFLYEYAR
RHPDYSVVLLLRLAKTYETTLEKCCAAADPHECYAKVFDEFKPLVEEP
QNLIKQNCELFEQLGEYKFQNALLVRYTKKVPQVSTPTLVEVSRNLGK
VGSKCCKHPEAKRMPCAEDYLSVVLNQLCVLHEKTPVSDRVTKCCTES
LVNRRPCFSALEVDETYVPKEFNAETFTFHADICTLSEKERQIKKQTA
LVELVKHKPKATKEQLKAVMDDFAAFVEKCCKADDKETCFAEEGKKLV
AASQAALGLGGGGSGGGGSCGADQFRCGNGSCVPRAWRCDGVDDCGDG
SDEAPEICETPTCQSNEFRCRSGRCIPQHWLCDGLNDCGDGSDESQQC
SAPASEPPGSLCGTNLFTCRSTNMCISQAWVCDGVDDCEDNSDETVCS
QDPEFHKV

C3201-HSA
(SEQ ID NO: 713)
SGGSCGADQFRCGNGSCVPRAWRCDGVDDCGDGSDEAPEICETPTCQS
NEFRCRSGRCIPQHWLCDGLNDCGDGSDESQQCSAPASEPPGSLCGEG
LFTCRSTNICISHAWVCDGVDDCEDNSDENNCSAPASEPPGSLGGGGS
GGGGSDAHKSEVAHRFKDLGEENFKALVLIAFAQYLQQCPFEDHVKLV
NEVTEFAKTCVADESAENCDKSLHTLFGDKLCTVATLRETYGEMADCC
AKQEPERNECFLQHKDDNPNLPRLVRPEVDVMCTAFHDNEETFLKKYL
YEIARRHPYFYAPELLFFAKRYKAAFTECCQAADKAACLLPKLDELRD
EGKASSAKQRLKCASLQKFGERAFKAWAVARLSQRFPKAEFAEVSKLV
TDLTKVHTECCHGDLLECADDRADLAKYICENQDSISSKLKECCEKPL
LEKSHCIAEVENDEMPADLPSLAADFVESKDVCKNYAEAKDVFLGMFL
YEYARRHPDYSVVLLLRLAKTYETTLEKCCAAADPHECYAKVFDEFKP
LVEEPQNLIKQNCELFEQLGEYKFQNALLVRYTKKVPQVSTPTLVEVS
RNLGKVGSKCCKHPEAKRMPCAEDYLSVVLNQLCVLHEKTPVSDRVTK
CCTESLVNRRPCFSALEVDETYVPKEFNAETFTFHADICTLSEKERQI
KKQTALVELVKHKPKATKEQLKAVMDDFAAFVEKCCKADDKETCFAEE
GKKLVAASQAALGL

C3203-HSA
(SEQ ID NO: 714)
SGGSCGADQFRCGNGSCVPRAWRCDGVDDCGDGSDEAPEICETPTCQS
NEFRCRSGRCIPQHWLCDGLNDCGDGSDESQQCSAPASEPPGSLCGTN
LFTCRSTNMCISQAWVCDGVDDCEDNSDETVCSQDPEFHKVGGGGSGG
GGSDAHKSEVAHRFKDLGEENFKALVLIAFAQYLQQCPFEDHVKLVNE
VTEFAKTCVADESAENCDKSLHTLFGDKLCTVATLRETYGEMADCCAK
QEPERNECFLQHKDDNPNLPRLVRPEVDVMCTAFHDNEETFLKKYLYE
IARRHPYFYAPELLFFAKRYKAAFTECCQAADKAACLLPKLDELRDEG
KASSAKQRLKCASLQKFGERAFKAWAVARLSQRFPKAEFAEVSKLVTD
LTKVHTECCHGDLLECADDRADLAKYICENQDSISSKLKECCEKPLLE
KSHCIAEVENDEMPADLPSLAADFVESKDVCKNYAEAKDVFLGMFLYE
YARRHPDYSVVLLLRLAKTYETTLEKCCAAADPHECYAKVFDEFKPLV
EEPQNLIKQNCELFEQLGEYKFQNALLVRYTKKVPQVSTPTLVEVSRN
LGKVGSKCCKHPEAKRMPCAEDYLSVVLNQLCVLHEKTPVSDRVTKCC
TESLVNRRPCFSALEVDETYVPKEFNAETFTFHADICTLSEKERQIKK
QTALVELVKHKPKATKEQLKAVMDDFAAFVEKCCKADDKETCFAEEGK
KLVAASQAALGL

C3094-HSA
(SEQ ID NO: 1282)
SGGSCLPDEFQCGSGRCIPQHWLCDGLNDCGDGSDEPPAHCSAPASEP
PGSLCRAGEFRCSNGRCVPLTWLCDGEDDCQDNSDEKNCAQPTCGEGL
FTCRSTNICISHAWVCDGVDDCEDNSDENNCSAPASEPPGSLGGGGSG
GGGSDAHKSEVAHRFKDLGEENFKALVLIAFAQYLQQCPFEDHVKLVN
EVTEFAKTCVADESAENCDKSLHTLFGDKLCTVATLRETYGEMADCCA
KQEPERNECFLQHKDDNPNLPRLVRPEVDVMCTAFHDNEETFLKKYLY
EIARRHPYFYAPELLFFAKRYKAAFTECCQAADKAACLLPKLDELRDE
GKASSAKQRLKCASLQKFGERAFKAWAVARLSQRFPKAEFAEVSKLVT
DLTKVHTECCHGDLLECADDRADLAKYICENQDSISSKLKECCEKPLL
EKSHCIAEVENDEMPADLPSLAADFVESKDVCKNYAEAKDVFLGMFLY
EYARRHPDYSVVLLLRLAKTYETTLEKCCAAADPHECYAKVFDEFKPL
VEEPQNLIKQNCELFEQLGEYKFQNALLVRYTKKVPQVSTPTLVEVSR
NLGKVGSKCCKHPEAKRMPCAEDYLSVVLNQLCVLHEKTPVSDRVTKC
CTESLVNRRPCFSALEVDETYVPKEFNAETFTFHADICTLSEKERQIK
KQTALVELVKHKPKATKEQLKAVMDDFAAFVEKCCKADDKETCFAEEG
KKLVAASQAALGL

HSA-C3094
(SEQ ID NO: 1331)
DAHKSEVAHRFKDLGEENFKALVLIAFAQYLQQCPFEDHVKLVNEVTE
FAKTCVADESAENCDKSLHTLFGDKLCTVATLRETYGEMADCCAKQEP
ERNECFLQHKDDNPNLPRLVRPEVDVMCTAFHDNEETFLKKYLYEIAR
RHPYFYAPELLFFAKRYKAAFTECCQAADKAACLLPKLDELRDEGKAS
SAKQRLKCASLQKFGERAFKAWAVARLSQRFPKAEFAEVSKLVTDLTK
VHTECCHGDLLECADDRADLAKYICENQDSISSKLKECCEKPLLEKSH
CIAEVENDEMPADLPSLAADFVESKDVCKNYAEAKDVFLGMFLYEYAR
RHPDYSVVLLLRLAKTYETTLEKCCAAADPHECYAKVFDEFKPLVEEP
QNLIKQNCELFEQLGEYKFQNALLVRYTKKVPQVSTPTLVEVSRNLGK
VGSKCCKHPEAKRMPCAEDYLSVVLNQLCVLHEKTPVSDRVTKCCTES
LVNRRPCFSALEVDETYVPKEFNAETFTFHADICTLSEKERQIKKQTA
LVELVKHKPKATKEQLKAVMDDFAAFVEKCCKADDKETCFAEEGKKLV
AASQAALGLGGGGSGGGGSCLPDEFQCGSGRCIPQHWLCDGLNDCGDG
SDEPPAHCSAPASEPPGSLCRAGEFRCSNGRCVPLTWLCDGEDDCQDN
SDEKNCAQPTCGEGLFTCRSTNICISHAWVCDGVDDCEDNSDENNCSA
PASEPPGSL

C4174-HSA
(SEQ ID NO: 1283)
SGGSCAPGEFTCKNTGRCIPLNWRCDGDDDCGDGSDETDCPAPTCPSN
QFPCRSTGICIPLAWVCDGLNDCGDGSDESPAHCSAPASEPPGSLCGE
GLFTCRSTNICISHAWVCDGVDDCEDNSDENNCSAPASEPPGSL
DAHKSEVAHRFKDLGEENFKALVLIAFAQYLQQCPFE
DHVKLVNEVTEFAKTCVADESAENCDKSLHTLFGDKLCTVATLRETYG
EMADCCAKQEPERNECFLQHKDDNPNLPRLVRPEVDVMCTAFHDNEET
FLKKYLYEIARRHPYFYAPELLFFAKRYKAAFTECCQAADKAACLLPK
LDELRDEGKASSAKQRLKCASLQKFGERAFKAWAVARLSQRFPKAEFA
EVSKLVTDLTKVHTECCHGDLLECADDRADLAKYICENQDSISSKLKE
CCEKPLLEKSHCIAEVENDEMPADLPSLAADFVESKDVCKNYAEAKDV
FLGMFLYEYARRHPDYSVVLLLRLAKTYETTLEKCCAAADPHECYAKV
FDEFKPLVEEPQNLIKQNCELFEQLGEYKFQNALLVRYTKKVPQVSTP
TLVEVSRNLGKVGSKCCKHPEAKRMPCAEDYLSVVLNQLCVLHEKTPV
SDRVTKCCTESLVNRRPCFSALEVDETYVPKEFNAETFTFHADICTLS
EKERQIKKQTALVELVKHKPKATKEQLKAVMDDFAAFVEKCCKADDKE
TCFAEEGKKLVAASQAALGL

HSA-C4174
(SEQ ID NO: 1332)
DAHKSEVAHRFKDLGEENFKALVLIAFAQYLQQCPFEDHVKLVNEVTE
FAKTCVADESAENCDKSLHTLFGDKLCTVATLRETYGEMADCCAKQEP
ERNECFLQHKDDNPNLPRLVRPEVDVMCTAFHDNEETFLKKYLYEIAR
RHPYFYAPELLFFAKRYKAAFTECCQAADKAACLLPKLDELRDEGKAS
SAKQRLKCASLQKFGERAFKAWAVARLSQRFPKAEFAEVSKLVTDLTK
VHTECCHGDLLECADDRADLAKYICENQDSISSKLKECCEKPLLEKSH
CIAEVENDEMPADLPSLAADFVESKDVCKNYAEAKDVFLGMFLYEYAR
RHPDYSVVLLLRLAKTYETTLEKCCAAADPHECYAKVFDEFKPLVEEP
QNLIKQNCELFEQLGEYKFQNALLVRYTKKVPQVSTPTLVEVSRNLGK
VGSKCCKHPEAKRMPCAEDYLSVVLNQLCVLHEKTPVSDRVTKCCTES
LVNRRPCFSALEVDETYVPKEFNAETFTFHADICTLSEKERQIKKQTA
LVELVKHKPKATKEQLKAVMDDFAAFVEKCCKADDKETCFAEEGKKLV
AASQAALGLGGGGSGGGGSCAPGEFTCKNTGRCIPLNWRCDGDDDCGD
GSDETDCPAPTCPSNQFPCRSTGICIPLAWVCDGLNDCGDGSDESPAH
CSAPASEPPGSLCGEGLFTCRSTNICISHAWVCDGVDDCEDNSDENNC
SAPASEPPGSL

C4176-HSA
(SEQ ID NO: 1284)
SGGSCGPDEFRCNNGQCIPLPWRCDGVDDCGDNSDEPLEICQAPTCQS
NEFRCRSGRCIPQHWLCDGLNDCGDGSDEPPAHCSAPASEPPGSLCGE
GLFTCRSTNICISHAWVCDGVDDCEDNSDENNCSAPASEPPGSLGGGG
SGGGGSDAHKSEVAHRFKDLGEENFKALVLIAFAQYLQQCPFEDHVKL
VNEVTEFAKTCVADESAENCDKSLHTLFGDKLCTVATLRETYGEMADC
CAKQEPERNECFLQHKDDNPNLPRLVRPEVDVMCTAFHDNEETFLKKY
LYEIARRHPYFYAPELLFFAKRYKAAFTECCQAADKAACLLPKLDELR
DEGKASSAKQRLKCASLQKFGERAFKAWAVARLSQRFPKAEFAEVSKL
VTDLTKVHTECCHGDLLECADDRADLAKYICENQDSISSKLKECCEKP
LLEKSHCIAEVENDEMPADLPSLAADFVESKDVCKNYAEAKDVFLGMF
LYEYARRHPDYSVVLLLRLAKTYETTLEKCCAAADPHECYAKVFDEFK
PLVEEPQNLIKQNCELFEQLGEYKFQNALLVRYTKKVPQVSTPTLVEV
SRNLGKVGSKCCKHPEAKRMPCAEDYLSVVLNQLCVLHEKTPVSDRVT
KCCTESLVNRRPCFSALEVDETYVPKEFNAETFTFHADICTLSEKERQ
IKKQTALVELVKHKPKATKEQLKAVMDDFAAFVEKCCKADDKETCFAE
EGKKLVAASQAALGL

HSA-C4176
(SEQ ID NO: 1333)
DAHKSEVAHRFKDLGEENFKALVLIAFAQYLQQCPFEDHVKLVNEVTE
FAKTCVADESAENCDKSLHTLFGDKLCTVATLRETYGEMADCCAKQEP

```
ERNECFLQHKDDNPNLPRLVRPEVDVMCTAFHDNEETFLKKYLYEIAR
RHPYFYAPELLFFAKRYKAAFTECCQAADKAACLLPKLDELRDEGKAS
SAKQRLKCASLQKFGERAFKAWAVARLSQRFPKAEFAEVSKLVTDLTK
VHTECCHGDLLECADDRADLAKYICENQDSISSKLKECCEKPLLEKSH
CIAEVENDEMPADLPSLAADFVESKDVCKNYAEAKDVFLGMFLYEYAR
RHPDYSVVLLLRLAKTYETTLEKCCAAADPHECYAKVFDEFKPLVEEP
QNLIKQNCELFEQLGEYKFQNALLVRYTKKVPQVSTPTLVEVSRNLGK
VGSKCCKHPEAKRMPCAEDYLSVVLNQLCVLHEKTPVSDRVTKCCTES
LVNRRPCFSALEVDETYVPKEFNAETFTFHADICTLSEKERQIKKQTA
LVELVKHKPKATKEQLKAVMDDFAAFVEKCCKADDKETCFAEEGKKLV
AASQAALGLGGGGSGGGGSCGPDEFRCNNGQCIPLPWRCDGVDDCGDN
SDEPLEICQAPTCQSNEFRCRSGRCIPQHWLCDGLNDCGDGSDEPPAH
CSAPASEPPGSLCGEGLFTCRSTNICISHAWVCDGVDDCEDNSDENNC
SAPASEPPGSL
```

In some embodiments any monomer or multimer that binds to FGFR1c or β-Klotho and FGFR1c and β-Klotho can be fused to HAS (SEQ ID NO:715)

```
                                         (SEQ ID NO: 715)
DAHKSEVAHRFKDLGEENFKALVLIAFAQYLQQCPFEDHVKLVNEVTE

FAKTCVADESAENCDKSLHTLFGDKLCTVATLRETYGEMADCCAKQEP

ERNECFLQHKDDNPNLPRLVRPEVDVMCTAFHDNEETFLKKYLYEIAR

RHPYFYAPELLFFAKRYKAAFTECCQAADKAACLLPKLDELRDEGKAS

SAKQRLKCASLQKFGERAFKAWAVARLSQRFPKAEFAEVSKLVTDLTK

VHTECCHGDLLECADDRADLAKYICENQDSISSKLKECCEKPLLEKSH

CIAEVENDEMPADLPSLAADFVESKDVCKNYAEAKDVFLGMFLYEYAR

RHPDYSVVLLLRLAKTYETTLEKCCAAADPHECYAKVFDEFKPLVEEP

QNLIKQNCELFEQLGEYKFQNALLVRYTKKVPQVSTPTLVEVSRNLGK

VGSKCCKHPEAKRMPCAEDYLSVVLNQLCVLHEKTPVSDRVTKCCTES

LVNRRPCFSALEVDETYVPKEFNAETFTFHADICTLSEKERQIKKQTA

LVELVKHKPKATKEQLKAVMDDFAAFVEKCCKADDKETCFAEEGKKLV

AASQAALGL
```

Figure 9:
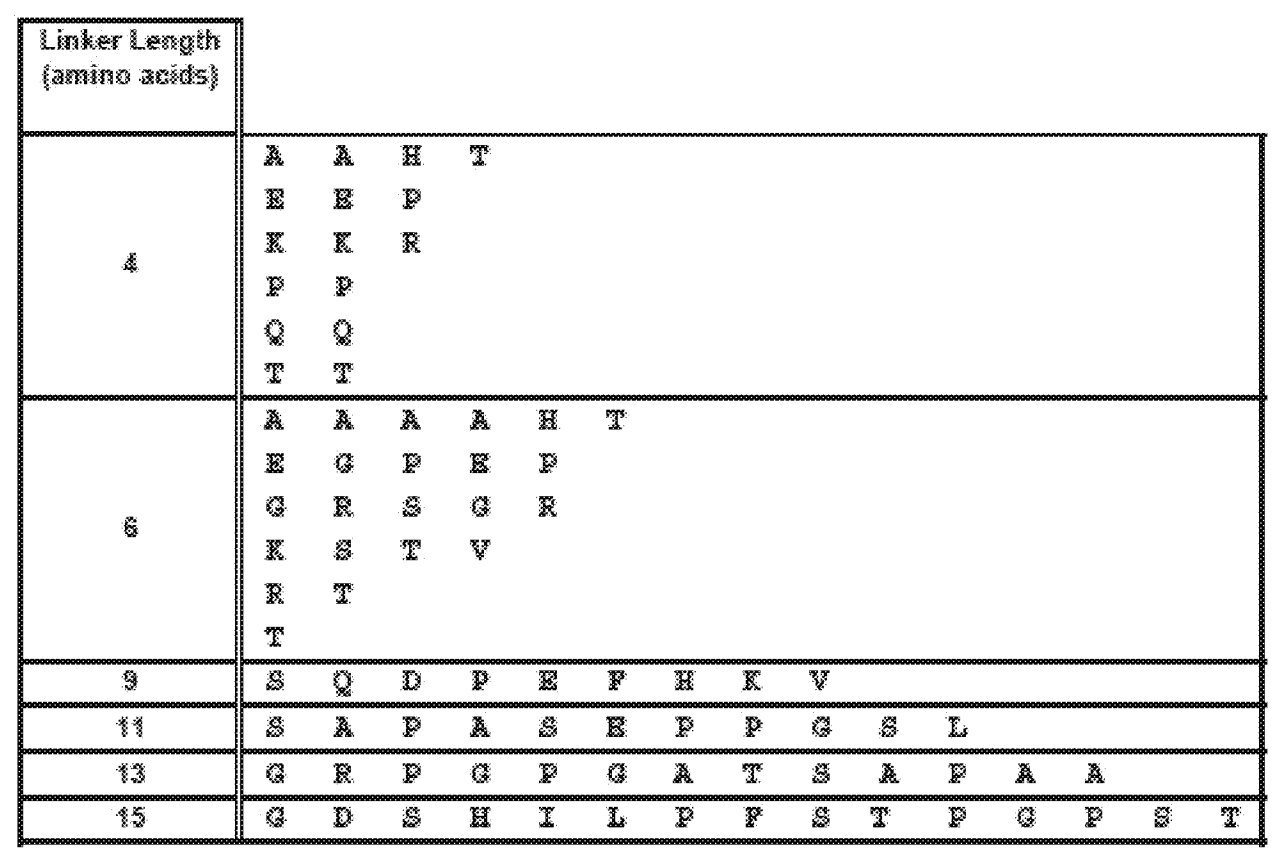
Figure 52:
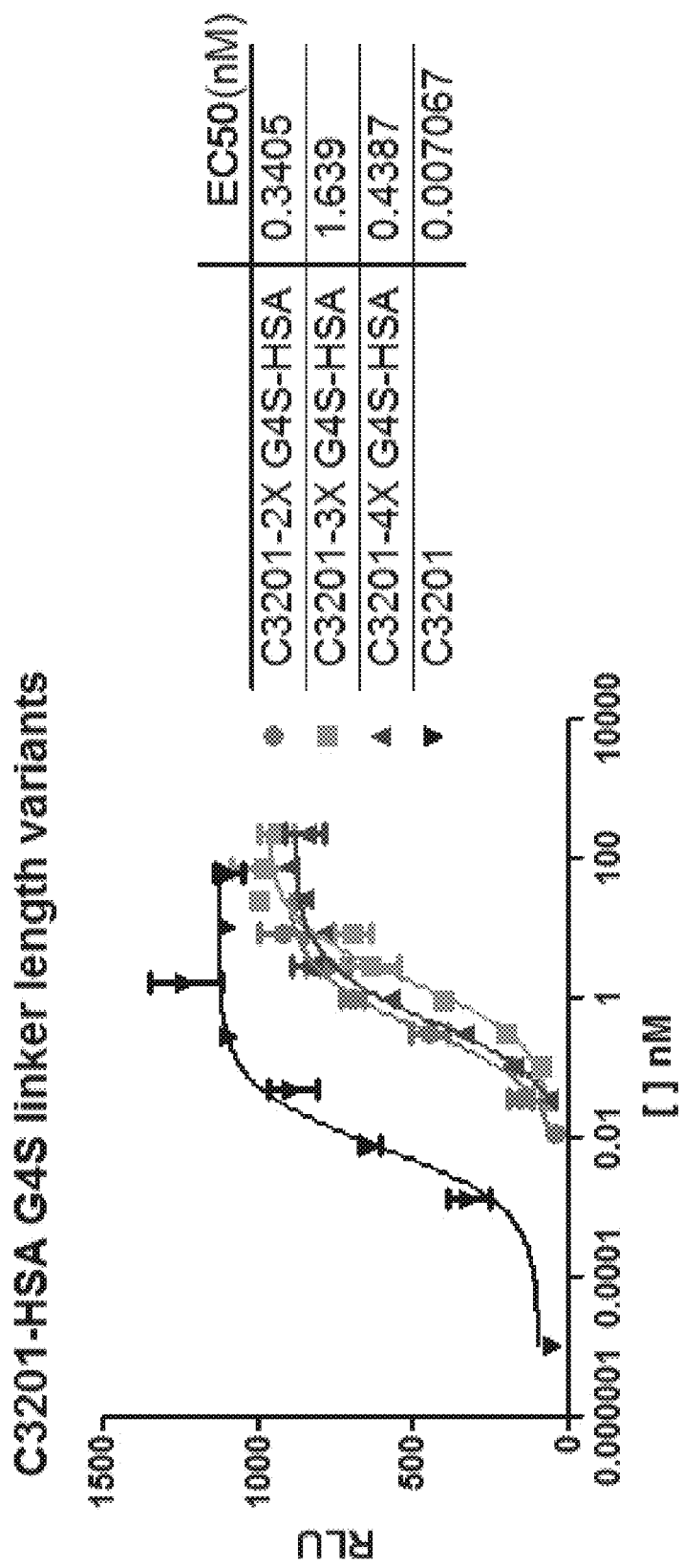
FIG. 52 is a series of plots generated using cells that express human FGFR1c and human β-Klotho, and demonstrate that binding proteins C3201-GGGGSGGGGSGGGGS-HSA (SEQ ID NO: 4) and C3201-GGGGSGGGGSGGGGSGGGGS-HSA (SEQ ID NO: 418) are able to induce FGF21-like signaling with equivalent potency and efficacy to C3201-HSA (SEQ ID NO:713), where the binding protein is linked to HSA by a GGGGSGGGGS (SEQ ID NO: 3) linker.

The monomers or multimers can be linked to HSA using any of the linkers described in FIG. 9 or any other polypeptide sequence. Joining the selected monomer domains via a linker can be accomplished using a variety of techniques known in the art. Linkers consisting of GGGGSGGGGS (SEQ ID NO: 3), GGGGSGGGGSGGGGS (SEQ ID NO: 4) and GGGGSGGGGSGGGGSGGGGS (SEQ ID NO: 418) have been used to linker C3201 (SEQ ID NO: 359) to HSA (SEQ ID NO: 715) with the resulting molecules retaining FGF-21 like agonist activity (FIG. 52). Exemplary sequences of such polypeptides include the following:

```
C3201-GGGGSGGGGS-HSA ("GGGGSGGGGS" is disclosed
as SEQ ID NO: 3)
                                         (SEQ ID NO: 713)
SGGSCGADQFRCGNGSCVPRAWRCDGVDDCGDGSDEAPEICETPTCQS
NEFRCRSGRCIPQHWLCDGLNDCGDGSDESQQCSAPASEPPGSLCGEG
LFTCRSTNICISHAWVCDGVDDCEDNSDENNCSAPASEPPGSLGGGGS
GGGGSDAHKSEVAHRFKDLGEENFKALVLIAFAQYLQQCPFEDHVKLV
NEVTEFAKTCVADESAENCDKSLHTLFGDKLCTVATLRETYGEMADCC
AKQEPERNECFLQHKDDNPNLPRLVRPEVDVMCTAFHDNEETFLKKYL
YEIARRHPYFYAPELLFFAKRYKAAFTECCQAADKAACLLPKLDELRD
EGKASSAKQRLKCASLQKFGERAFKAWAVARLSQRFPKAEFAEVSKLV
TDLTKVHTECCHGDLLECADDRADLAKYICENQDSISSKLKECCEKPL
LEKSHCIAEVENDEMPADLPSLAADFVESKDVCKNYAEAKDVFLGMFL
YEYARRHPDYSVVLLLRLAKTYETTLEKCCAAADPHECYAKVFDEFKP
LVEEPQNLIKQNCELFEQLGEYKFQNALLVRYTKKVPQVSTPTLVEVS
RNLGKVGSKCCKHPEAKRMPCAEDYLSVVLNQLCVLHEKTPVSDRVTK
CCTESLVNRRPCFSALEVDETYVPKEFNAETFTFHADICTLSEKERQI
KKQTALVELVKHKPKATKEQLKAVMDDFAAFVEKCCKADDKETCFAEE
GKKLVAASQAALGL C3201-GGGGSGGGGSGGGGS-HSA ("GGGGSGGGGSGGGGS" is
disclosed as SEQ ID NO: 4)
                                        (SEQ ID NO: 1285)
SGGSCGADQFRCGNGSCVPRAWRCDGVDDCGDGSDEAPEICETPTCQS
NEFRCRSGRCIPQHWLCDGLNDCGDGSDESQQCSAPASEPPGSLCGEG
LFTCRSTNICISHAWVCDGVDDCEDNSDENNCSAPASEPPGSLGGGGS
GGGGSGGGGSDAHKSEVAHRFKDLGEENFKALVLIAFAQYLQQCPFED
HVKLVNEVTEFAKTCVADESAENCDKSLHTLFGDKLCTVATLRETYGE
MADCCAKQEPERNECFLQHKDDNPNLPRLVRPEVDVMCTAFHDNEETF
LKKYLYEIARRHPYFYAPELLFFAKRYKAAFTECCQAADKAACLLPKL
DELRDEGKASSAKQRLKCASLQKFGERAFKAWAVARLSQRFPKAEFAE
VSKLVTDLTKVHTECCHGDLLECADDRADLAKYICENQDSISSKLKEC
CEKPLLEKSHCIAEVENDEMPADLPSLAADFVESKDVCKNYAEAKDVF
LGMFLYEYARRHPDYSVVLLLRLAKTYETTLEKCCAAADPHECYAKVF
DEFKPLVEEPQNLIKQNCELFEQLGEYKFQNALLVRYTKKVPQVSTPT
LVEVSRNLGKVGSKCCKHPEAKRMPCAEDYLSVVLNQLCVLHEKTPVS
DRVTKCCTESLVNRRPCFSALEVDETYVPKEFNAETFTFHADICTLSE
KERQIKKQTALVELVKHKPKATKEQLKAVMDDFAAFVEKCCKADDKET
CFAEEGKKLVAASQAALGL C3201-GGGGSGGGGSGGGGSGGGGS-HSA
("GGGGSGGGGSGGGGSGGGGS" is disclosed
as SEQ ID NO: 418)
                                        (SEQ ID NO: 1286)
SGGSCGADQFRCGNGSCVPRAWRCDGVDDCGDGSDEAPEICETPTCQS
NEFRCRSGRCIPQHWLCDGLNDCGDGSDESQQCSAPASEPPGSLCGEG
LFTCRSTNICISHAWVCDGVDDCEDNSDENNCSAPASEPPGSLGGGGS
GGGGSGGGGSGGGGSDAHKSEVAHRFKDLGEENFKALVLIAFAQYLQQ
CPFEDHVKLVNEVTEFAKTCVADESAENCDKSLHTLFGDKLCTVATLR
ETYGEMADCCAKQEPERNECFLQHKDDNPNLPRLVRPEVDVMCTAFHD
NEETFLKKYLYEIARRHPYFYAPELLFFAKRYKAAFTECCQAADKAAC
LLPKLDELRDEGKASSAKQRLKCASLQKFGERAFKAWAVARLSQRFPK
AEFAEVSKLVTDLTKVHTECCHGDLLECADDRADLAKYICENQDSISS
KLKECCEKPLLEKSHCIAEVENDEMPADLPSLAADFVESKDVCKNYAE
AKDVFLGMFLYEYARRHPDYSVVLLLRLAKTYETTLEKCCAAADPHEC
YAKVFDEFKPLVEEPQNLIKQNCELFEQLGEYKFQNALLVRYTKKVPQ
VSTPTLVEVSRNLGKVGSKCCKHPEAKRMPCAEDYLSVVLNQLCVLHE
KTPVSDRVTKCCTESLVNRRPCFSALEVDETYVPKEFNAETFTFHADI
CTLSEKERQIKKQTALVELVKHKPKATKEQLKAVMDDFAAFVEKCCKA
DDKETCFAEEGKKLVAASQAALGL
```

In some embodiments the fusions of binding protein domains and HSA can be expressed in mammalian cells using a variety of techniques known in the art. Expression in mammalian cells can result in addition of carbohydrate moeities to the side chains of certain amino acids. These glycosylation sites can be identified by a number of publically available algorithms. N-linked glycosylation occurs when carbohydrate moeities are added to the side chain of asparigine residues if the asparigine is located in the context of the consensus motif N-X-[S/T] (SEQ ID NO: 1287), where X can be any amino acid except for proline. The recognition motifs for O-linked glycosylation (addition of carbohydrate moeities to the side chains of serine or threonine residues) are less well defined, with O-linked glycosylation occurring preferentially on serine and threonine residues found in the context of proline-rich sequences.

Analysis of binding protein-HSA fusion C3201-HSA (SEQ ID NO: 713) identified an N-linked glycosylation site at N16 and an O-linked glycosylation site at S86. The following dual mutations were made to eliminate these glycosylation sites to improve protein homogeneity.

```
C3201-HSA (N14S/S86G)
                                        (SEQ ID NO: 1288)
SGGSCGADQFRCGSGSCVPRAWRCDGVDDCGDGSDEAPEICETPTCQS
NEFRCRSGRCIPQHWLCDGLNDCGDGSDESQQCSAPAGEPPGSLCGEG
LFTCRSTNICISHAWVCDGVDDCEDNSDENNCSAPASEPPGSLGGGGS
GGGGSDAHKSEVAHRFKDLGEENFKALVLIAFAQYLQQCPFEDHVKLV
NEVTEFAKTCVADESAENCDKSLHTLFGDKLCTVATLRETYGEMADCC
AKQEPERNECFLQHKDDNPNLPRLVRPEVDVMCTAFHDNEETFLKKYL
```

Figure 53:
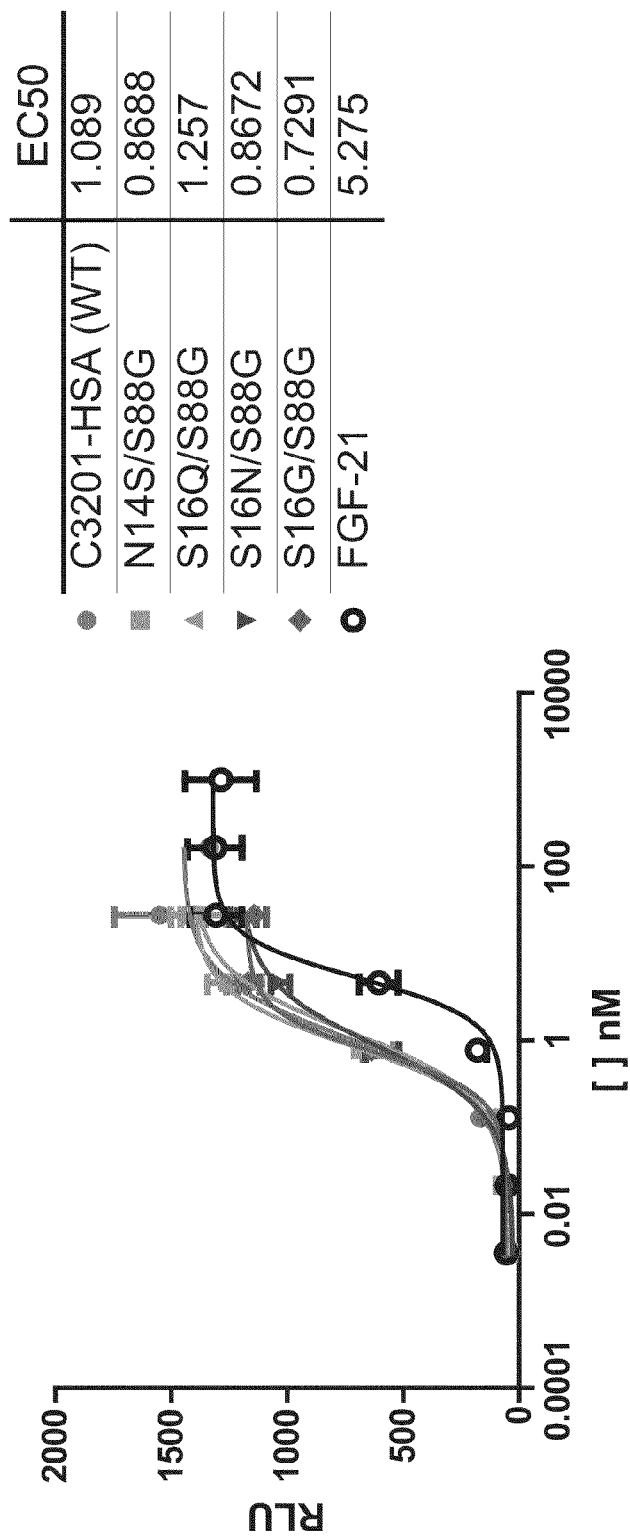
FIG. 53 is a series of plots generated using cells that express human FGFR1c and human β-Klotho, and demonstrate that binding proteins C3201-HSA (SEQ ID NO:713), C3201-HSA (N14S/S86G) (SEQ ID NO: 1288), C3201-HSA (S16Q/S86G) (SEQ ID NO: 1289), C3201-HSA (S16N/S86G) (SEQ ID NO: 1290) and C3201-HSA (S16G/S86G) (SEQ ID NO: 1291) are able to induce FGF21-like signaling with equivalent potency and efficacy.

-continued
YEIARRHPYFYAPELLFFAKRYKAAFTECCQAADKAACLLPKLDELRD
EGKASSAKQRLKCASLQKFGERAFKAWAVARLSQRFPKAEFAEVSKLV
TDLTKVHTECCHGDLLECADDRADLAKYICENQDSISSKLKECCEKPL
LEKSHCIAEVENDEMPADLPSLAADFVESKDVCKNYAEAKDVFLGMFL
YEYARRHPDYSVVLLLRLAKTYETTLEKCCAAADPHECYAKVFDEFKP
LVEEPQNLIKQNCELFEQLGEYKFQNALLVRYTKKVPQVSTPTLVEVS
RNLGKVGSKCCKHPEAKRMPCAEDYLSVVLNQLCVLHEKTPVSDRVTK
CCTESLVNRRPCFSALEVDETYVPKEFNAETFTFHADICTLSEKERQI
KKQTALVELVKHKPKATKEQLKAVMDDFAAFVEKCCKADDKETCFAEE
GKKLVAASQAALGL C3201-HSA (S16Q/S86G)
(SEQ ID NO: 1289)
SGGSCGADQFRCGNGQCVPRAWRCDGVDDCGDGSDEAPEICETPTCQS
NEFRCRSGRCIPQHWLCDGLNDCGDGSDESQQCSAPAGEPPGSLCGEG
LFTCRSTNICISHAWVCDGVDDCEDNSDENNCSAPASEPPGSLGGGGS
GGGGSDAHKSEVAHRFKDLGEENFKALVLIAFAQYLQQCPFEDHVKLV
NEVTEFAKTCVADESAENCDKSLHTLFGDKLCTVATLRETYGEMADCC
AKQEPERNECFLQHKDDNPNLPRLVRPEVDVMCTAFHDNEETFLKKYL
YEIARRHPYFYAPELLFFAKRYKAAFTECCQAADKAACLLPKLDELRD
EGKASSAKQRLKCASLQKFGERAFKAWAVARLSQRFPKAEFAEVSKLV
TDLTKVHTECCHGDLLECADDRADLAKYICENQDSISSKLKECCEKPL
LEKSHCIAEVENDEMPADLPSLAADFVESKDVCKNYAEAKDVFLGMFL
YEYARRHPDYSVVLLLRLAKTYETTLEKCCAAADPHECYAKVFDEFKP
LVEEPQNLIKQNCELFEQLGEYKFQNALLVRYTKKVPQVSTPTLVEVS
RNLGKVGSKCCKHPEAKRMPCAEDYLSVVLNQLCVLHEKTPVSDRVTK
CCTESLVNRRPCFSALEVDETYVPKEFNAETFTFHADICTLSEKERQI
KKQTALVELVKHKPKATKEQLKAVMDDFAAFVEKCCKADDKETCFAEE
KKLVAASQAALGL C3201-HSA (S16N/S86G)
(SEQ ID NO: 1290)
SGGSCGADQFRCGNGNCVPRAWRCDGVDDCGDGSDEAPEICETPTCQS
NEFRCRSGRCIPQHWLCDGLNDCGDGSDESQQCSAPAGEPPGSLCGEG
LFTCRSTNICISHAWVCDGVDDCEDNSDENNCSAPASEPPGSLGGGGS
GGGGSDAHKSEVAHRFKDLGEENFKALVLIAFAQYLQQCPFEDHVKLV
NEVTEFAKTCVADESAENCDKSLHTLFGDKLCTVATLRETYGEMADCC
AKQEPERNECFLQHKDDNPNLPRLVRPEVDVMCTAFHDNEETFLKKYL
YEIARRHPYFYAPELLFFAKRYKAAFTECCQAADKAACLLPKLDELRD
EGKASSAKQRLKCASLQKFGERAFKAWAVARLSQRFPKAEFAEVSKLV
TDLTKVHTECCHGDLLECADDRADLAKYICENQDSISSKLKECCEKPL
LEKSHCIAEVENDEMPADLPSLAADFVESKDVCKNYAEAKDVFLGMFL
YEYARRHPDYSVVLLLRLAKTYETTLEKCCAAADPHECYAKVFDEFKP
LVEEPQNLIKQNCELFEQLGEYKFQNALLVRYTKKVPQVSTPTLVEVS
RNLGKVGSKCCKHPEAKRMPCAEDYLSVVLNQLCVLHEKTPVSDRVTK
CCTESLVNRRPCFSALEVDETYVPKEFNAETFTFHADICTLSEKERQI
KKQTALVELVKHKPKATKEQLKAVMDDFAAFVEKCCKADDKETCFAEE
GKKLVAASQAALGL C3201-HSA (S16G/S86G)
(SEQ ID NO: 1291)
SGGSCGADQFRCGNGGCVPRAWRCDGVDDCGDGSDEAPEICETPTCQS
NEFRCRSGRCIPQHWLCDGLNDCGDGSDESQQCSAPAGEPPGSLCGEG
LFTCRSTNICISHAWVCDGVDDCEDNSDENNCSAPASEPPGSLGGGGS
GGGGSDAHKSEVAHRFKDLGEENFKALVLIAFAQYLQQCPFEDHVKLV
NEVTEFAKTCVADESAENCDKSLHTLFGDKLCTVATLRETYGEMADCC
AKQEPERNECFLQHKDDNPNLPRLVRPEVDVMCTAFHDNEETFLKKYL
YEIARRHPYFYAPELLFFAKRYKAAFTECCQAADKAACLLPKLDELRD
EGKASSAKQRLKCASLQKFGERAFKAWAVARLSQRFPKAEFAEVSKLV
TDLTKVHTECCHGDLLECADDRADLAKYICENQDSISSKLKECCEKPL
LEKSHCIAEVENDEMPADLPSLAADFVESKDVCKNYAEAKDVFLGMFL
YEYARRHPDYSVVLLLRLAKTYETTLEKCCAAADPHECYAKVFDEFKP
LVEEPQNLIKQNCELFEQLGEYKFQNALLVRYTKKVPQVSTPTLVEVS
RNLGKVGSKCCKHPEAKRMPCAEDYLSVVLNQLCVLHEKTPVSDRVTK
CCTESLVNRRPCFSALEVDETYVPKEFNAETFTFHADICTLSEKERQI
KKQTALVELVKHKPKATKEQLKAVMDDFAAFVEKCCKADDKETCFAEE
GKKLVAASQAALGL After these changes have been made the binding protein-HSA fusions retain the same FGF-21-like agonist activity in reporter cell and primary adipocyte assays as the parent binding protein-HSA fusion (FIG. 53).

C. Fusion to a Monovalent IgG-Fc Domain

In some embodiments binding protein domains are fused to either the N- or C-terminus of a monovalent human IgG-Fc, consisting of two heavy chain Fcs linked by a (G4S)7 linker (GGGGSGGGGSGGGGSGGGGSGGGGSGGGGSGGGGS) (SEQ ID: 1292). This monovalent human IgG-Fc is described herein and in the associated Figures by the abbreviation "HCFC."

Monovalent human IgG2-Fc (HCFC)
(SEQ ID: 1293)
ERKSSVECPPCPAPPVAGPSVFLFPPKPKDTLMISRTPEVTCVVVDVS
HEDPEVQFNWYVDGVEVHNAKTKPREEQFNSTFRVVSVLTVVHQDWLN
GKEYKCKVSNKGLPAPIEKTISKTKGQPREPQVYTLPPSREEMTKNQV
SLTCLVKGFYPSDIAVEWESNGQPENNYKTTPPMLDSDGSFFLYSKLT
VDKSRWQQGNVFSCSVMHEALHNHYTQKSLSLSPGGGGSGGGGSGGG
GSGGGGSGGGGSGGGGSGGGGSGGGGSERKSSVECPPCPAPPVAGPSV
FLFPPKPKDTLMISRTPEVTCVVVDVSHEDPEVQFNWYVDGVEVHNAK
TKPREEQFNSTFRVVSVLTVVHQDWLNGKEYKCKVSNKGLPAPIEKTI
SKTKGQPREPQVYTLPPSREEMTKNQVSLTCLVKGFYPSDIAVEWESN
GQPENNYKTTPPMLDSDGSFFLYSKLTVDKSRWQQGNVFSCSVMHEAL
HNHYTQKSLSLSPG This confers an extended half life on the binding protein by targeting the binding protein (as part of the binding protein-monovalent human IgG-Fc polypeptide) to the FcRn scavenger pathway. Additionally, the increase in mass prevents loss of the intact binding protein-monovalent human IgG-Fc from serum by kidney filtration.

Binding protein-monovalent human IgG-Fc fusions can be expressed in bacteria, yeast or mammalian cells.

Figure 54:
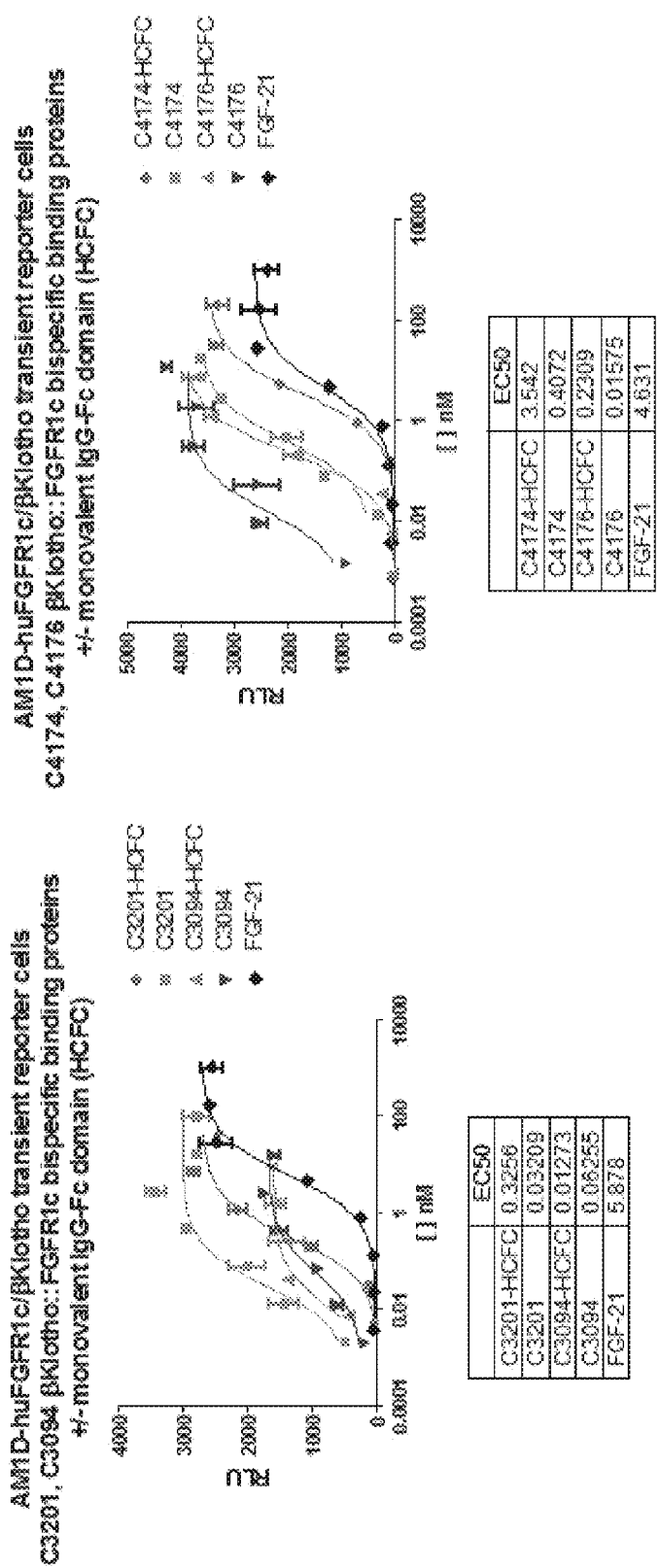
FIG. 54: is a series of plots generated using cells that express human FGFR1c and human β-Klotho, and demonstrate that binding proteins C3094-HCFC(SEQ ID NO: 1295), C3201-HCFC(SEQ ID NO: 1294), C4174-HCFC (SEQ ID NO: 1296) and C4176-HCFC (SEQ ID NO: 1297) are able to induce FGF21-like signaling.

A FGFR1c/βKlotho binding protein can be linked to the N- or C-terminus of monovalent human IgG-Fc. The binding protein sequence can be linked directly to the monovalent human IgG-Fc coding sequence, or via an intermediate linking sequence. In this context the binding protein still functions as an agonist, able to induce FGF21-like signaling in a reporter cell assay (FIG. 54). Exemplary sequences of such polypeptides include the following:

C3201-HCFC
(SEQ ID NO: 1294)
SGGSCGADQFRCGNGSCVPRAWRCDGVDDCGDGSDEAPEICETPTCQS
NEFRCRSGRCIPQHWPCDGLNDCGDGSDESQQCSAPASEPPGSLCGEG
LFTCRSTNICISHAWVCDGVDDCEDNSDENNCSAPASEPPGSLASGGG
GSGGGGERKSSVECPPCPAPPVAGPSVFLFPPKPKDTLMISRTPEVTC
VVVDVSHEDPEVQFNWYVDGVEVHNAKTKPREEQFNSTFRVVSVLTVV
HQDWLNGKEYKCKVSNKGLPAPIEKTISKTKGQPREPQVYTLPPSREE
MTKNQVSLTCLVKGFYPSDIAVEWESNGQPENNYKTTPPMLDSDGSFF
LYSKLTVDKSRWQQGNVFSCSVMHEALHNHYTQKSLSLSPGGGGSGGG
GGSGGGGSGGGGSGGGGSGGGGSGGGGSGGGGSERKSSVECPPCPAPP
VAGPSVFLFPPKPKDTLMISRTPEVTCVVVDVSHEDPEVQFNWYVDGV
EVHNAKTKPREEQFNSTFRVVSVLTVVHQDWLNGKEYKCKVSNKGLPA
PIEKTISKTKGQPREPQVYTLPPSREEMTKNQVSLTCLVKGFYPSDIA
VEWESNGQPENNYKTTPPMLDSDGSFFLYSKLTVDKSRWQQGNVFSCS
VMHEALHNHYTQKSLSLSPG

C3094-HCFC
(SEQ ID NO: 1295)
SGGSCLPDEFQCGSGRCIPQHWLCDGLNDCGDGSDEPPAHCSAPASEP
PGSLCRAGEFRCSNGRCVPLTWLCDGEDDCQDNSDEKNCAQPTCGEGL
FTCRSTNICISHAWVCDGVDDCEDNSDENNCSAPASEPPGSLASGGGG
SGGGGERKSSVECPPCPAPPVAGPSVFLFPPKPKDTLMISRTPEVTCV
VVDVSHEDPEVQFNWYVDGVEVHNAKTKPREEQFNSTFRVVSVLTVVH
QDWLNGKEYKCKVSNKGLPAPIEKTISKTKGQPREPQVYTLPPSREEM
TKNQVSLTCLVKGFYPSDIAVEWESNGQPENNYKTTPPMLDSDGSFFL
YSKLTVDKSRWQQGNVFSCSVMHEALHNHYTQKSLSLSPGGGGSGGG
GSGGGGSGGGGSGGGGSGGGGSGGGGSGGGGSERKSSVECPPCPAPPV
AGPSVFLFPPKPKDTLMISRTPEVTCVVVDVSHEDPEVQFNWYVDGVE
VHNAKTKPREEQFNSTFRVVSVLTVVHQDWLNGKEYKCKVSNKGLPAP
IEKTISKTKGQPREPQVYTLPPSREEMTKNQVSLTCLVKGFYPSDIAV
EWESNGQPENNYKTTPPMLDSDGSFFLYSKLTVDKSRWQQGNVFSCSV
MHEALHNHYTQKSLSLSPG

C4174-HCFC (SEQ ID NO: 1296)
SGGSCAPGEFTCKNTGRCIPLNWRCDGDDDCGDGSDETDCPAPTCPSN
QFPCRSTGICIPLAWVCDGLNDCGDGSDESPAHCSAPASEPPGSLCGE
GLFTCRSTNICISHAWVCDGVDDCEDNSDENNCSAPASEPPGSLASGG
GGSGGGGERKSSVECPPCPAPPVAGPSVFLFPPKPKDTLMISRTPEVT
CVVVDVSHEDPEVQFNWYVDGVEVHNAKTKPREEQFNSTFRVVSVLTV
VHQDWLNGKEYKCKVSNKGLPAPIEKTISKTKGQPREPQVYTLPPSRE
EMTKNQVSLTCLVKGFYPSDIAVEWESNGQPENNYKTTPPMLDSDGSF
FLYSKLTVDKSRWQQGNVFSCSVMHEALHNHYTQKSLSLSPGGGGGSG
GGGSGGGGSGGGGSGGGGSGGGGSGGGGSGGGGSERKSSVECPPCPAP
PVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLP
APIEKTISKTKGQPREPQVYTLPPSREEMTKNQVSLTCLVKGFYPSDI
AVEWESNGQPENNYKTTPPMLDSDGSFFLYSKLTVDKSRWQQGNVFSC
SVMHEALHNHYTQKSLSLSPG

C4176-HCFC (SEQ ID NO: 1297)
SGGSCGPDEFRCNNGQCIPLPWRCDGVDDCGDNSDEPLEICQAPTCQS
NEFRCRSGRCIPQHWLCDGLNDCGDGSDEPPAHCSAPASEPPGSLCGE
GLFTCRSTNICISHAWVCDGVDDCEDNSDENNCSAPASEPPGSLASGG
GGSGGGGERKSSVECPPCPAPPVAGPSVFLFPPKPKDTLMISRTPEVT
CVVVDVSHEDPEVQFNWYVDGVEVHNAKTKPREEQFNSTFRVVSVLTV
VHQDWLNGKEYKCKVSNKGLPAPIEKTISKTKGQPREPQVYTLPPSRE
EMTKNQVSLTCLVKGFYPSDIAVEWESNGQPENNYKTTPPMLDSDGSF
FLYSKLTVDKSRWQQGNVFSCSVMHEALHNHYTQKSLSLSPGGGGGSG
GGGSGGGGSGGGGSGGGGSGGGGSGGGGSGGGGSERKSSVECPPCPAP
PVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLP
APIEKTISKTKGQPREPQVYTLPPSREEMTKNQVSLTCLVKGFYPSDI
AVEWESNGQPENNYKTTPPMLDSDGSFFLYSKLTVDKSRWQQGNVFSC
SVMHEALHNHYTQKSLSLSPG

The monomers or multimers described above can be linked to the monovalent human IgG-Fc by the linker ASGGGGSGGGG (SEQ ID NO: 1298). In addition, the monomers or multimers can be linked to the monovalent human IgG-Fc by a using any of the linkers described herein, for example those presented in FIG. 9, or via any other polypeptide sequence, including those commonly regarded as linker sequences (e.g., a $(G_xS)_y$ sequence, wherein G is glycine, S is serine and x and y are independently any number). Joining the selected monomer domains via a linker can be accomplished using any technique known in the art, including standard peptide chemistry.

D. PEGylation

In some embodiments N-terminal sequences are added to the binding protein molecule to permit addition of polyethylene glycol (PEG) moieties via amide linkage chemistry. Addition of PEG increases the hydrodynamic radius of the binding protein, thus reducing excretion via kidney filtration. PEG molecules available for such purposes come in a range of molecular weights and as either linear or branched molecules. Linear or branched PEG molecules of any size can be employed (e.g., 10 kDa, 20 kDa, 30 kDa, 40 kDa, 50 kDa, 60 kDa, 70 kDa, 80 kDa, 90 kDa or 100 kDa.)

Covalently linking PEG to the binding protein via amide linkage chemistry requires an available primary amine A primary amine can be, e.g., the N-terminal amine or the amine side chain of any lysine residues within the polypeptide sequence. Lysine residues can be engineered out of the polypeptide sequence, being replaced with arginine residues to conserve positive charge and maintain activity. Exemplary sequences where one or more internal lysine residues was substituted with one or more arginine residues, and which maintained biological activity, include the following;

Parent Sequences;

(SEQ ID NO: 368)
CGANLFTCRSTNICISPAWVCDGVDDCEDYSDEIGCSQDPEFHKVCGA
DQFRCGNGSCVPRAWRCDGVDDCGDGSDEAPEICETPTCQSNEFRCRS
GRCIPQHWLCDGLNDCGDGSDESQQCSAPASEPPGSL (SEQ ID NO: 716)
CGANLFTCQSTNICISPAWVCDGVDDCEDYSDEIGCSQDPEFHKVCGA
DQFRCGNGSCVPRAWRCDGVDDCGDGSDEAPEICETPTCQSNEFRCRS
GRCIPQHWLCDGLNDCGDGSDESQQCSAPASEPPGSL (SEQ ID NO: 717)
CGADQFRCGNGSCVPRAWRCDGVDDCGDGSDEAPEICETPTCQSNEFR
CRSGRCIPQHWLCDGLNDCGDGSDESQQCSAPASEPPGSLCGANLFTC
QSTNICISPAWVCDGVDDCEDYSDEIGCSQDPEFHKV (SEQ ID NO: 718)
CGANLFTCRSSNICISPAWVCDGVDDCEDYSDEIGCSQDPEFHKVCGA
DQFRCGNGSCVPRAWRCDGVDDCGDGSDEAPEICETPTCQSNEFRCRS
GRCIPQHWLCDGLNDCGDGSDESQQCSAPASEPPGSL (SEQ ID NO: 719)
CGADQFRCGNGSCVPRAWRCDGVDDCGDGSDEAPEICETPTCQSNEFR
CRSGRCIPQHWLCDGLNDCGDGSDESQQCSAPASEPPGSLCGANLFTC
RSSNICISPAWVCDGVDDCEDYSDEIGCSQDPEFHKV (SEQ ID NO: 720)
CGADQFRCGNGSCVPRAWRCDGVDDCGDGSDEAPEICETPTCQSNEFR
CRSGRCIPQHWLCDGLNDCGDGSDESQQCSAPASEPPGSLCGANLFTC
RSTNICISDAWVCDGVDDCEDYSDEIGCSQDPEFHKV (SEQ ID NO: 721)
CGANLFTCRSTNICISPAWVCDGVDDCEDNSDEIGCSQDPEFHKVCGA
DQFRCGNGSCVPRAWRCDGVDDCGDGSDEAPEICETPTCQSNEFRCRS
GRCIPQHWLCDGLNDCGDGSDESQQCSAPASEPPGSL (SEQ ID NO: 722)
CGADQFRCGNGSCVPRAWRCDGVDDCGDGSDEAPEICETPTCQSNEFR
CRSGRCIPQHWLCDGLNDCGDGSDESQQCSAPASEPPGSLCGANLFTC
RSTNICISPAWVCDGVDDCEDNSDEIGCSQDPEFHKV (SEQ ID NO: 723)
CGANLFTCRSTNICISPAWVCDGVDDCEDYSDETGCSQDPEFHKVCGA
DQFRCGNGSCVPRAWRCDGVDDCGDGSDEAPEICETPTCQSNEFRCRS
GRCIPQHWLCDGLNDCGDGSDESQQCSAPASEPPGSL (SEQ ID NO: 724)
CGADQFRCGNGSCVPRAWRCDGVDDCGDGSDEAPEICETPTCQSNEFR
CRSGRCIPQHWLCDGLNDCGDGSDESQQCSAPASEPPGSLCGANLFTC
RSTNICISPAWVCDGVDDCEDYSDETGCSQDPEFHKV (SEQ ID NO: 725)
CGANLFTCRSTNICISPAWVCDGVDDCEDYSDEITCSQDPEFHKVCGA
DQFRCGNGSCVPRAWRCDGVDDCGDGSDEAPEICETPTCQSNEFRCRS
GRCIPQHWLCDGLNDCGDGSDESQQCSAPASEPPGSL (SEQ ID NO: 726)
CGADQFRCGNGSCVPRAWRCDGVDDCGDGSDEAPEICETPTCQSNEFR
CRSGRCIPQHWLCDGLNDCGDGSDESQQCSAPASEPPGSLCGANLFTC
RSTNICISPAWVCDGVDDCEDYSDEITCSQDPEFHKV (SEQ ID NO: 361)
CGADQFRCGNGSCVPRAWRCDGVDDCGDGSDEAPEICETPTCQSNEFR
CRSGRCIPQHWLCDGLNDCGDGSDESQQCSAPASEPPGSLCGTNLFTC
RSTNMCISQAWVCDGVDDCEDNSDETVCSQDPEFHKV (SEQ ID NO: 390)
CLPDEFQCGSGRCIPQHWLCDGLNDCGDGSDEPPAHCSAPASEPPGSL
CRAGEFRCSNGRCVPLTWLCDGEDDCQDNSDEKNCAQPTCGANQFTCH
NTNICISQAWVCDGVDDCEDNSDEKNCSAPASEPPGSL

Modified sequences (K to R substitution);

(SEQ ID NO: 727)
CGANLFTCRSTNICISPAWVCDGVDDCEDYSDEIGCSQDPEFHRVCGA
DQFRCGNGSCVPRAWRCDGVDDCGDGSDEAPEICETPTCQSNEFRCRS
GRCIPQHWLCDGLNDCGDGSDESQQCSAPASEPPGSL (SEQ ID NO: 728)
CGANLFTCQSTNICISPAWVCDGVDDCEDYSDEIGCSQDPEFHRVCGA
DQFRCGNGSCVPRAWRCDGVDDCGDGSDEAPEICETPTCQSNEFRCRS
GRCIPQHWLCDGLNDCGDGSDESQQCSAPASEPPGSL

-continued (SEQ ID NO: 729)
CGADQFRCGNGSCVPRAWRCDGVDDCGDGSDEAPEICETPTCQSNEFR
CRSGRCIPQHWLCDGLNDCGDGSDESQQCSAPASEPPGSLCGANLFTC
QSTNICISPAWVCDGVDDCEDYSDEIGCSQDPEFHRV (SEQ ID NO: 730)
CGANLFTCRSSNICISPAWVCDGVDDCEDYSDEIGCSQDPEFHRVCGA
DQFRCGNGSCVPRAWRCDGVDDCGDGSDEAPEICETPTCQSNEFRCRS
GRCIPQHWLCDGLNDCGDGSDESQQCSAPASEPPGSL (SEQ ID NO: 731)
CGADQFRCGNGSCVPRAWRCDGVDDCGDGSDEAPEICETPTCQSNEFR
CRSGRCIPQHWLCDGLNDCGDGSDESQQCSAPASEPPGSLCGANLFTC
RSSNICISPAWVCDGVDDCEDYSDEIGCSQDPEFHRV (SEQ ID NO: 732)
CGADQFRCGNGSCVPRAWRCDGVDDCGDGSDEAPEICETPTCQSNEFR
CRSGRCIPQHWLCDGLNDCGDGSDESQQCSAPASEPPGSLCGANLFTC
RSTNICISDAWVCDGVDDCEDYSDEIGCSQDPEFHRV (SEQ ID NO: 733)
CGANLFTCRSTNICISPAWVCDGVDDCEDNSDEIGCSQDPEFHRVCGA
DQFRCGNGSCVPRAWRCDGVDDCGDGSDEAPEICETPTCQSNEFRCRS
GRCIPQHWLCDGLNDCGDGSDESQQCSAPASEPPGSL (SEQ ID NO: 734)
CGADQFRCGNGSCVPRAWRCDGVDDCGDGSDEAPEICETPTCQSNEFR
CRSGRCIPQHWLCDGLNDCGDGSDESQQCSAPASEPPGSLCGANLFTC
RSTNICISPAWVCDGVDDCEDNSDEIGCSQDPEFHRV (SEQ ID NO: 735)
CGANLFTCRSTNICISPAWVCDGVDDCEDYSDETGCSQDPEFHRVCGA
DQFRCGNGSCVPRAWRCDGVDDCGDGSDEAPEICETPTCQSNEFRCRS
GRCIPQHWLCDGLNDCGDGSDESQQCSAPASEPPGSL (SEQ ID NO: 736)
CGADQFRCGNGSCVPRAWRCDGVDDCGDGSDEAPEICETPTCQSNEFR
CRSGRCIPQHWLCDGLNDCGDGSDESQQCSAPASEPPGSLCGANLFTC
RSTNICISPAWVCDGVDDCEDYSDETGCSQDPEFHRV (SEQ ID NO: 737)
CGANLFTCRSTNICISPAWVCDGVDDCEDYSDEITCSQDPEFHRVCGA
DQFRCGNGSCVPRAWRCDGVDDCGDGSDEAPEICETPTCQSNEFRCRS
GRCIPQHWLCDGLNDCGDGSDESQQCSAPASEPPGSL (SEQ ID NO: 738)
CGADQFRCGNGSCVPRAWRCDGVDDCGDGSDEAPEICETPTCQSNEFR
CRSGRCIPQHWLCDGLNDCGDGSDESQQCSAPASEPPGSLCGANLFTC
RSTNICISPAWVCDGVDDCEDYSDEITCSQDPEFHRV (SEQ ID NO: 739)
CGADQFRCGNGSCVPRAWRCDGVDDCGDGSDEAPEICETPTCQSNEFR
CRSGRCIPQHWLCDGLNDCGDGSDESQQCSAPASEPPGSLCGTNLFTC
RSTNMCISQAWVCDGVDDCEDNSDETVCSQDPEFHRV (SEQ ID NO: 740)
CLPDEFQCGSGRCIPQHWLCDGLNDCGDGSDEPPAHCSAPASEPPGSL
CRAGEFRCSNGRCVPLTWLCDGEDDCQDNSDERNCAQPTCGANQFTCH
NTNICISQAWVCDGVDDCEDNSDERNCSAPASEPPGSL N-terminal sequences that permit addition of one PEG molecule to the N-terminal primary amine include the following;

MDY
MHY
MHH
MRD
MRY
MYV

In various embodiments two PEG molecules can be added to the N-terminal region; one PEG molecule can be added at the N-terminal primary amine, and one PEG molecule can be added at an internal lysine residue. Examples of N-terminal sequences that permit addition of two PEG molecules to a binding protein include the following;

MKH
MDK
MEK
MRK
MYK
MHK
MKK

| | |
|---|---|
| MDYK | (SEQ ID NO: 741) |
| MHYK | (SEQ ID NO: 742) |
| MHHK | (SEQ ID NO: 743) |
| MRDK | (SEQ ID NO: 744) |
| MRYK | (SEQ ID NO: 745) |
| MYVK | (SEQ ID NO: 746) |
| MDYSK | (SEQ ID NO: 747) |
| MHYSK | (SEQ ID NO: 748) |
| MHHSK | (SEQ ID NO: 749) |
| MRDSK | (SEQ ID NO: 750) |
| MRYSK | (SEQ ID NO: 751) |
| MYVSK | (SEQ ID NO: 752) |
| MDYSAK | (SEQ ID NO: 753) |
| MHYSAK | (SEQ ID NO: 754) |
| MHHSAK | (SEQ ID NO: 755) |
| MRDSVK | (SEQ ID NO: 756) |
| MRYSVK | (SEQ ID NO: 757) |
| MYVSVK | (SEQ ID NO: 758) |
| MRDSVSVK | (SEQ ID NO: 759) |
| MRDSVYAK | (SEQ ID NO: 760) |
| MRDSVRDSVK | (SEQ ID NO: 761) |
| MRDSVYARDK | (SEQ ID NO: 762) |
| MRDSVRDYASVK | (SEQ ID NO: 763) |
| MRDSVGGGGSVK | (SEQ ID NO: 764) |
| MRDSVGGGGSGGGGSVK | (SEQ ID NO: 765) |
| MRDSVYARDYGGGGSGGGGSVK | (SEQ ID NO: 766) |
| MRDSVGGGGSGGGGSGGGGSVK | (SEQ ID NO: 767) |

Example 13

Cynomolgous Monkey Study

The binding protein construct designated as C3201-HSA was generated using the methodology disclosed in Examples 1-11. C3201-HSA comprises the binding protein C3201 fused to human serum albumin (HSA), but is referred to in the instant Example and in the associated figures by the shorthand "C3201." The binding protein component of C3201 is described by the sequence of SEQ ID NO:359, which comprises β-Klotho walked dimer WD29 (SEQ ID NO:312), and FGFR1c mutM09 (SEQ ID NO:297). When fused with the half-life extender HSA (SEQ ID NO:715), C3201 (i.e., C3201-HSA) comprised the sequence of SEQ ID NO:713. C3201 was expressed, purified and characterized as described herein and was studied in vivo in obese cynomolgus monkeys. The experimental design and results are shown below.

13.1 Study Design

The study was conducted in obese cynomolgus monkeys. The monkeys were 8-19 years old. Their body weights ranged from 7-14 kg and BMI ranged from 36-74 kg/m$^2$. Monkeys were acclimated for 6 weeks prior to the initiation of compound administration. During the acclimation period, the monkeys were familiarized with study-related procedures, including chair-restraint, subcutaneous injection (PBS, 0.1 ml/kg), gavage (Water, 10 ml/kg), and blood drawn for non-OGTT and OGTT samples. After 4 weeks of training, baseline OGTT and plasma metabolic parameters were measured. 30 monkeys were selected and randomized into two treatment groups to achieve similar baseline levels of body weight, glucose OGTT profiles, and plasma glucose and triglyceride levels.

Figure 55:
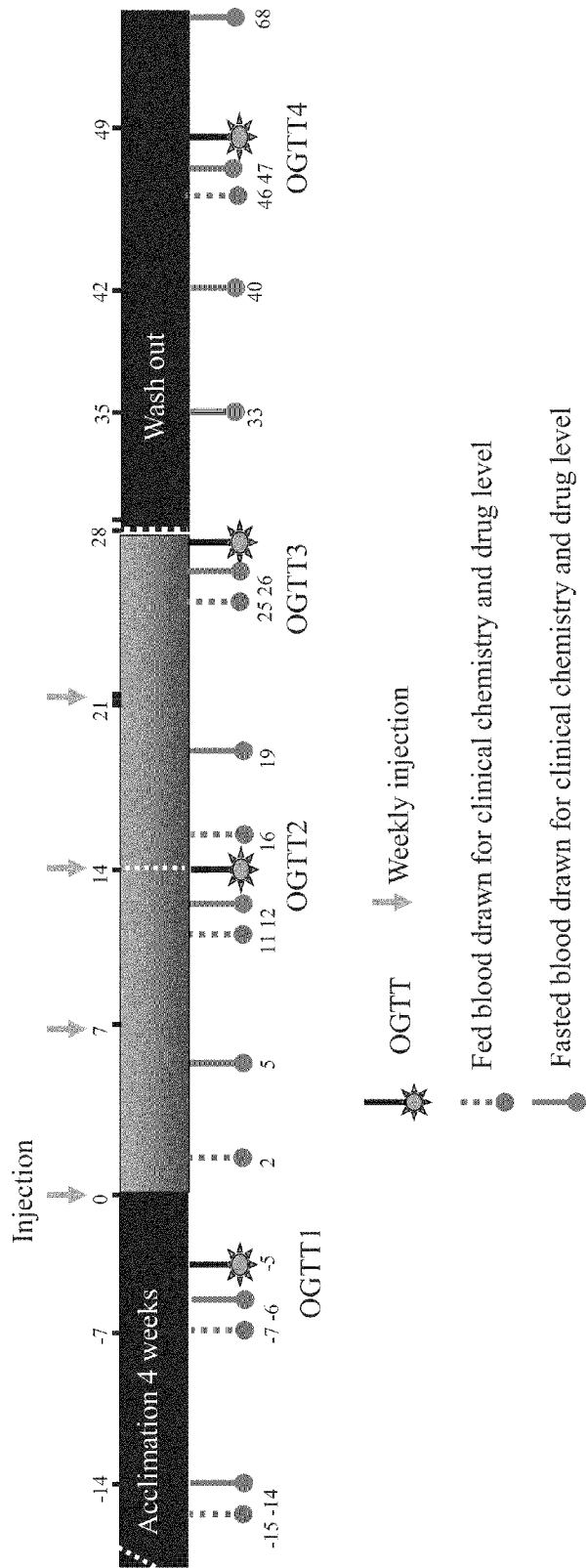
FIG. 55 is a diagram graphically depicting the study design for a 68 days study performed in obese cynomolgous monkeys.

The study was conducted in a blinded fashion. Vehicle (n=10), C3201-HSA low dose (n=10), C3201-HSA high dose (n=10). Compound was administered weekly at 0.5 mg/kg for the first 2 weeks for C3201-HSA low dose and 2.5 mg/kg for C3201-HSA high dose and at 1 mg/kg for the last 2 weeks for C3201-HSA low dose and 5 mg/kg for C3201-HSA high dose. After 4 injections of C3201-HSA, animals were monitored during an additional 6 weeks for compound washout and recovery from treatments. Food intake, body weight, clinical chemistry and OGTT were monitored throughout the study. Food intake was measured every meal. Body weight was measured weekly. Blood samples were collected on different days in fasted or fed state to measure glucose, insulin and triglyceride levels. OGTTs were conducted every two weeks after the initiation of the study. The day starting the treatment is designated as 0 and the detailed study plan is shown in FIG. 55.

The results presented in this Example represent data collected throughout the 68 days of the study.

13.2 Effect of C3201-HSA on Food Intake

Animals were fed twice a day, with each animal receiving 120 g of formulated food established during the acclimation period. The remaining food was removed and weighed after each meal to calculate food intake. The feeding times were from 8:00 AM to 8:30 AM (±30 minutes) and then from 4:30 PM to 5:00 PM (±30 minutes). Fruit (apple, 150 g) was supplied to each animal at 11:30 to 12:30 PM (±30 minutes) every day.

Figure 56:
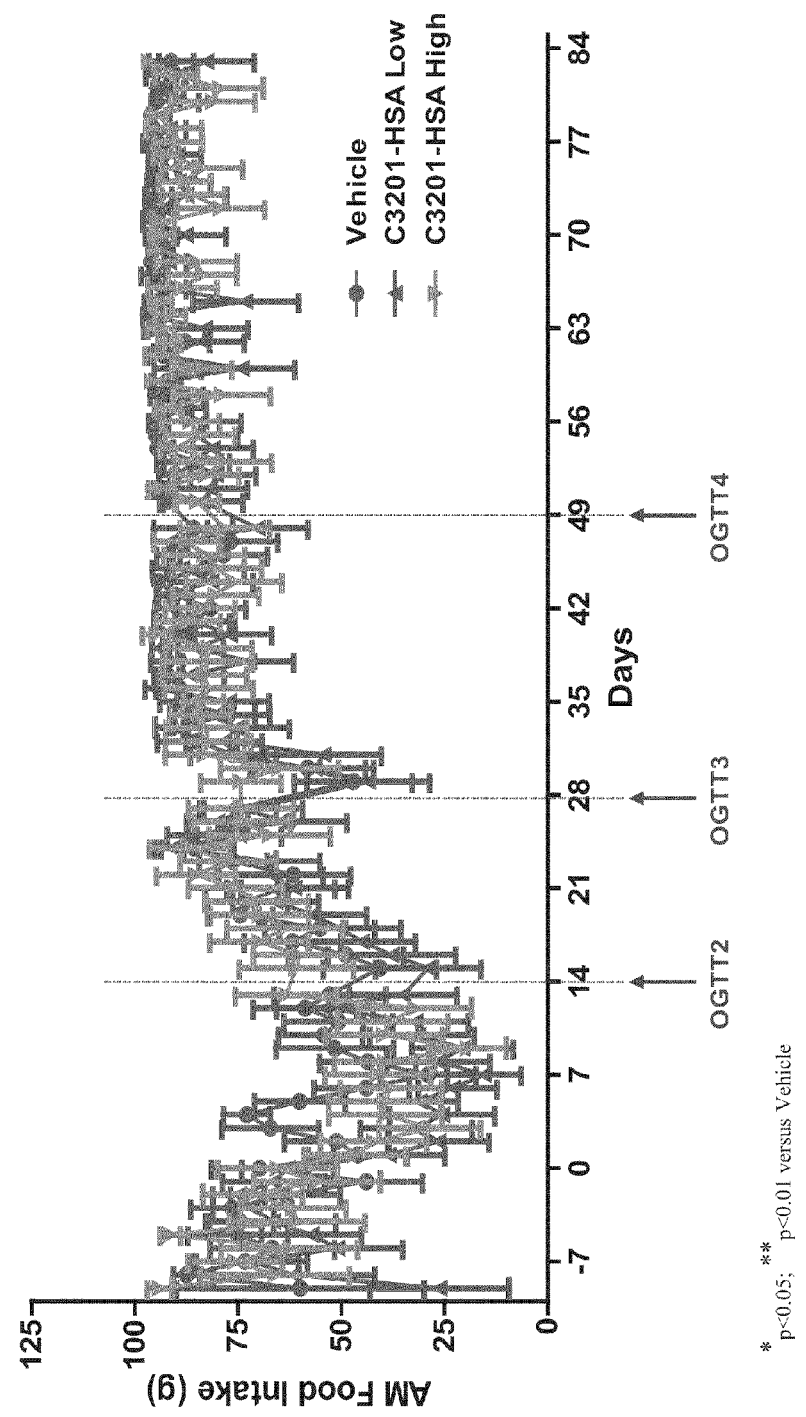
FIG. 56 is a plot depicting the effects of vehicle and C3201-HSA (SEQ ID NO: 713) on AM meal food intake of the obese cynomolgous monkeys studied.
Figure 57:
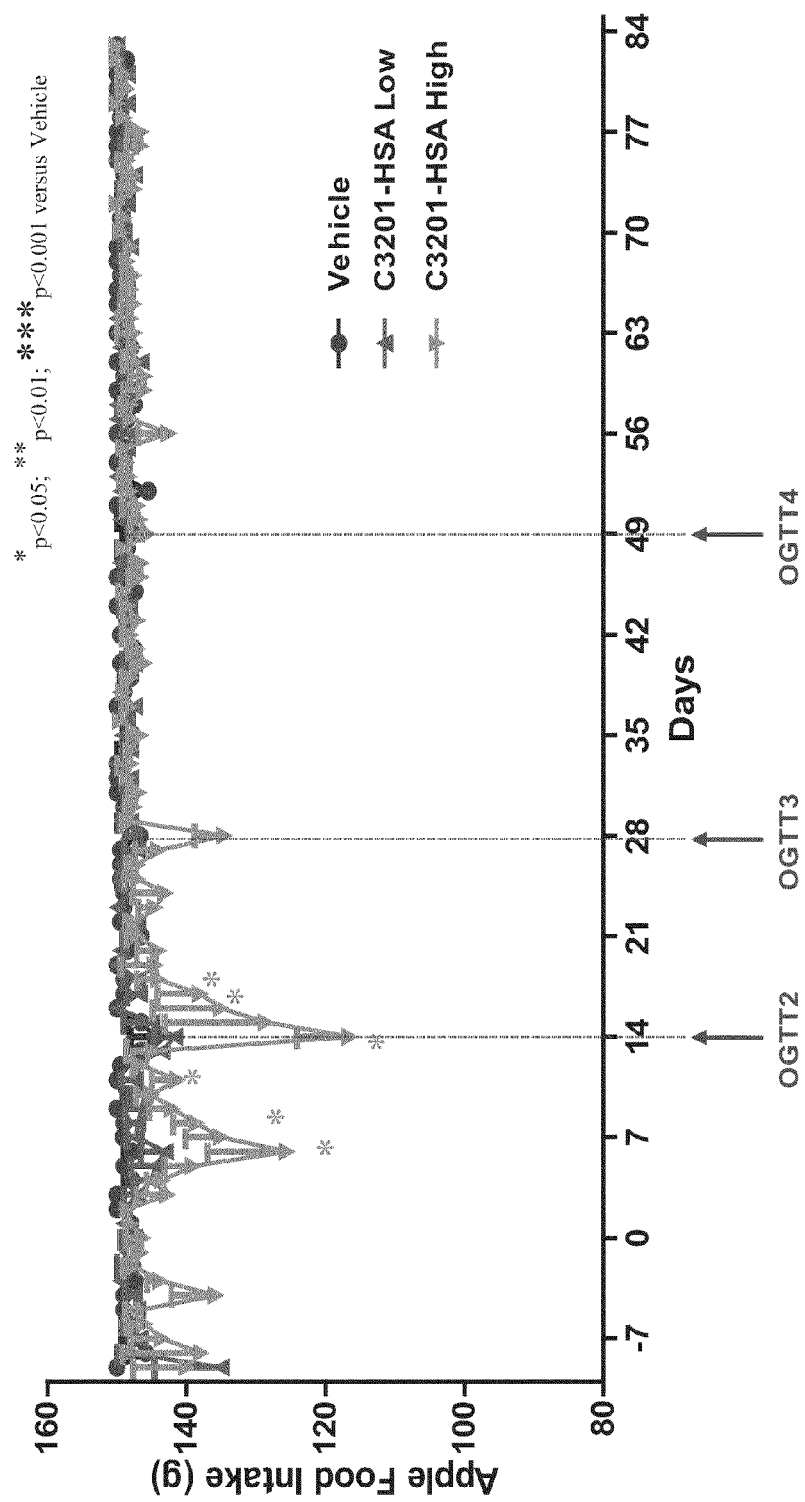
FIG. 57 is a plot depicting the effects of vehicle and C3201-HSA (SEQ ID NO: 713) on apple intake of the obese cynomolgous monkeys studied.
Figure 58:
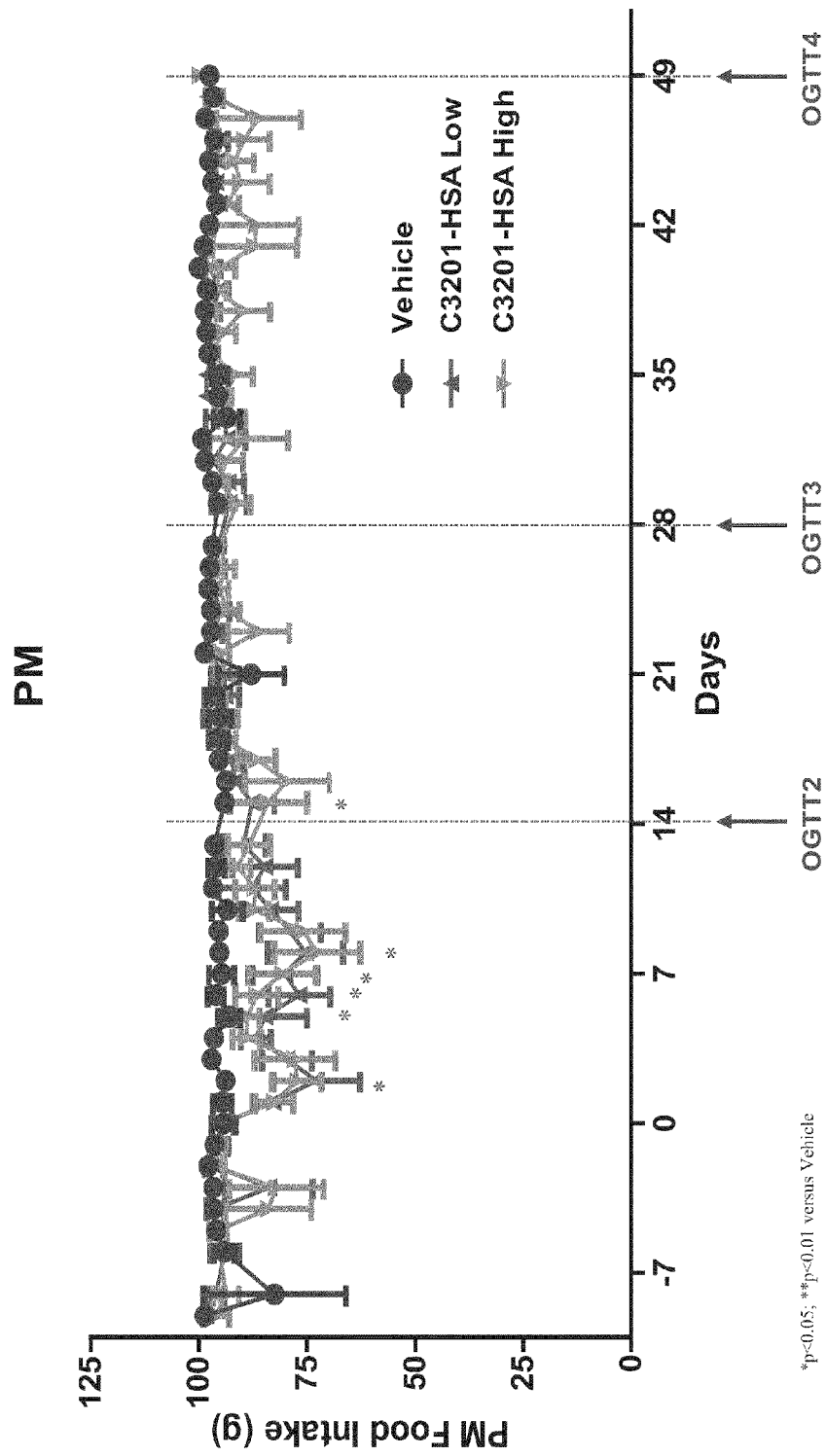
FIG. 58 is a plot depicting the effects of vehicle and C3201-HSA (SEQ ID NO: 713) on PM meal food intake of the obese cynomolgous monkeys studied.

Compared with vehicle, C3201-HSA low and high dose (n=10) did not reduced AM food intake in the monkeys (FIG. 56). However, apple food intake was significantly reduced between 7 and 21 days (FIG. 57) and PM food intake was statistically significantly decreased with the low and high dose (FIG. 58). However, the effect diminished and the food intake returned to close to baseline or control levels at 21 days (FIG. 58).

13.3 Effect of C3201-HSA on Body Weight

Figure 59:
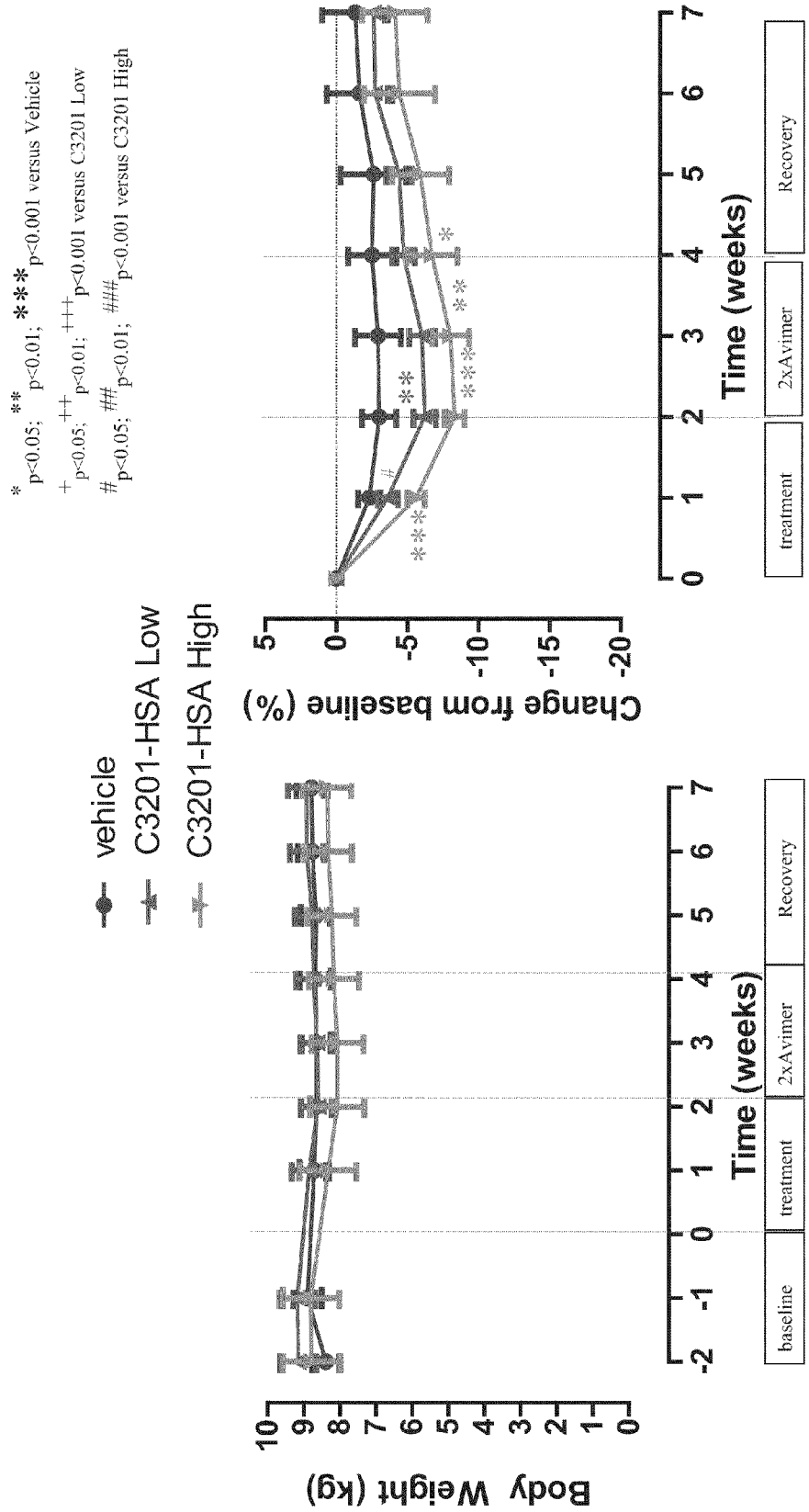
FIG. 59 is a plot depicting the effects of vehicle and C3201-HSA (SEQ ID NO: 713) on body weight of the obese cynomolgous monkeys studied.

Body weight was monitored weekly throughout the study. Over the course of the 4 week treatments, the body weight of animals treated with vehicle remained constant while body weight of animals treated with C3201-HSA (low and high doses) progressively decreased. Body weight returned to baseline by the end of the 6 weeks wash out period (FIG. 59).

13.4 Effect of C3201-HSA on Body Mass Index (BMI), Abdominal Circumference (AC) and Skin Fold Thickness (SFT)

Figure 60:
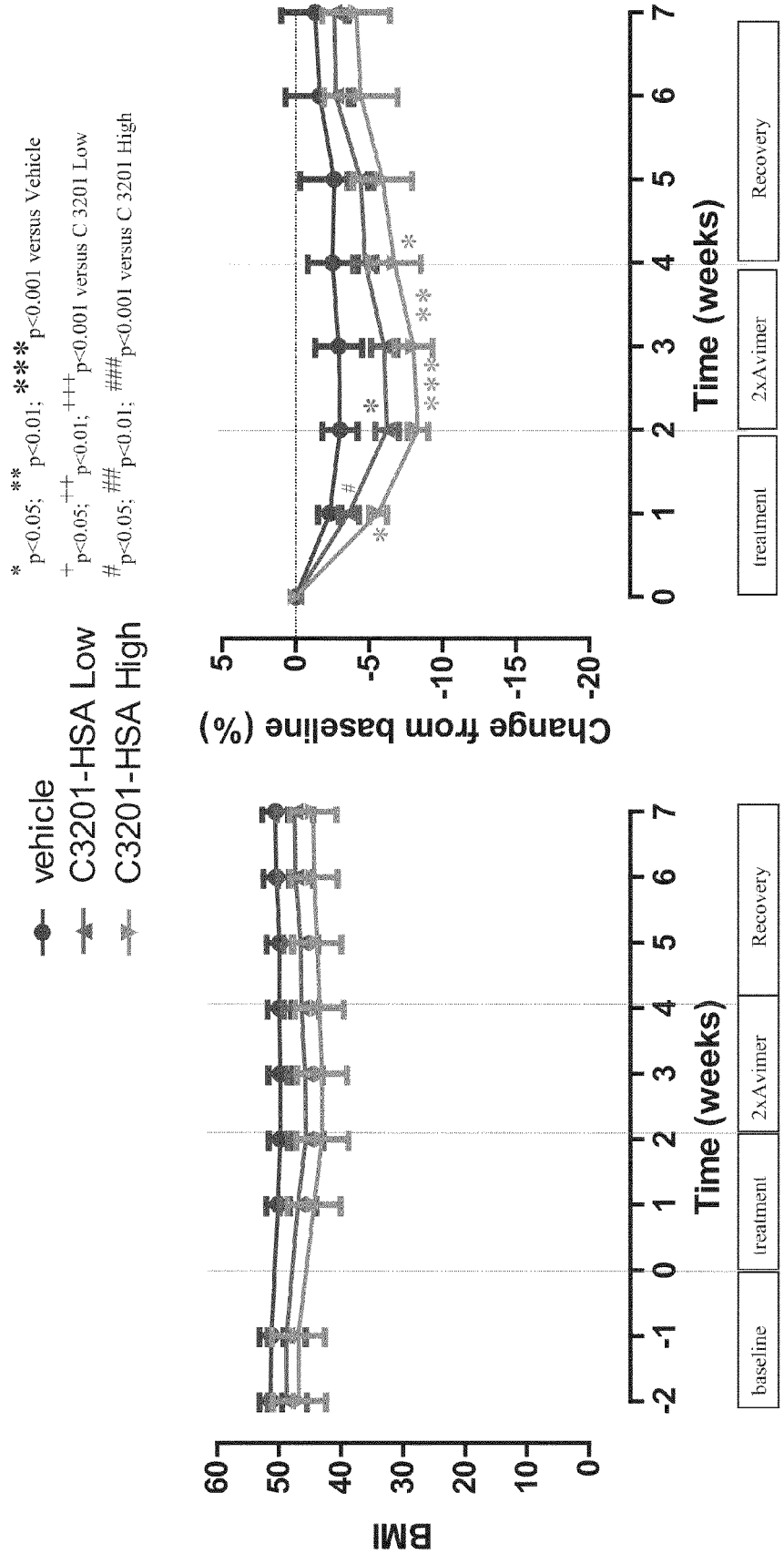
FIG. 60 is a plot showing the effects of vehicle and C3201-HSA (SEQ ID NO: 713) on body mass index (BMI) of the obese cynomolgous monkeys studied.
Figure 61:
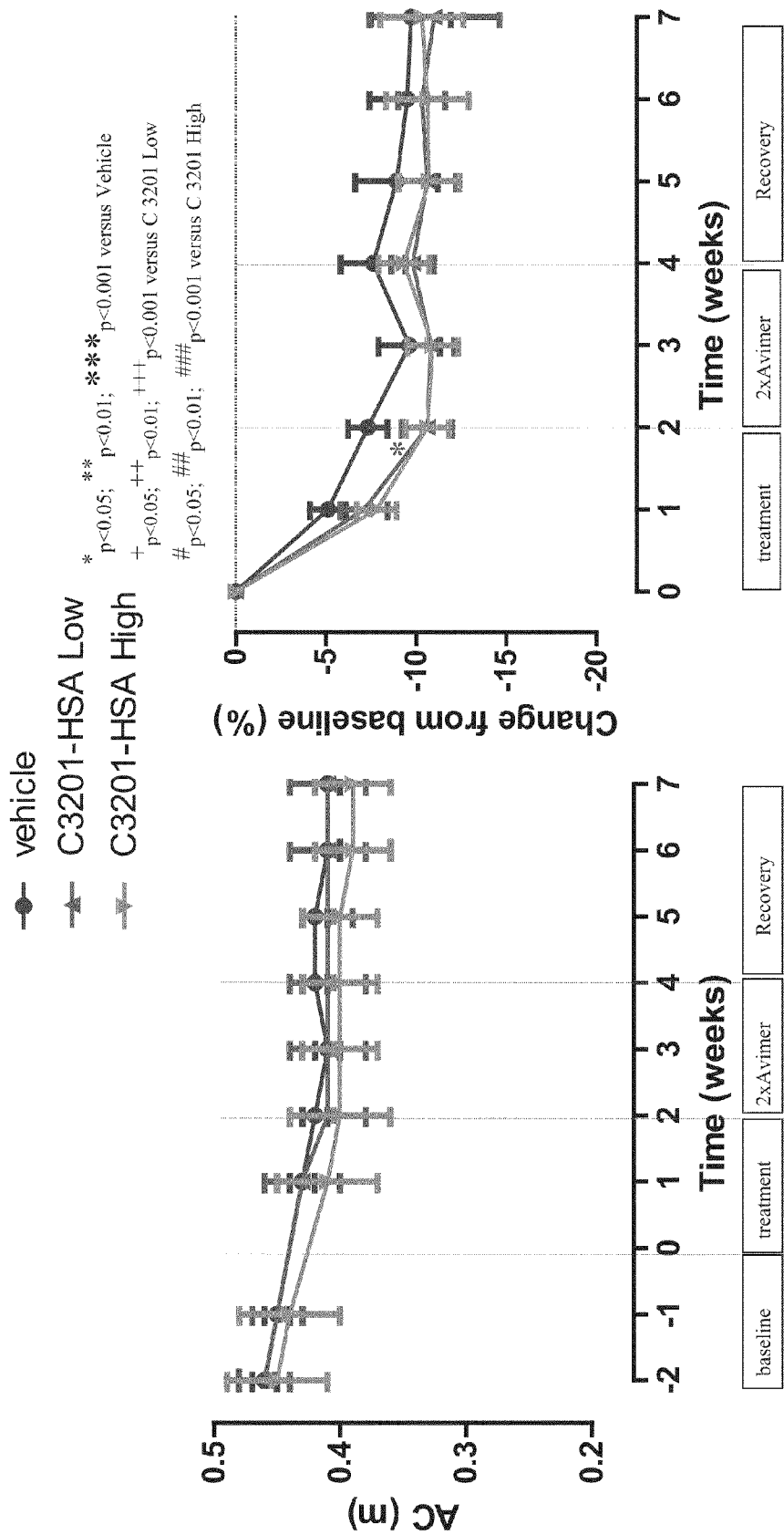
FIG. 61 is a plot showing the effects of vehicle and C3201-HSA (SEQ ID NO: 713) on abdominal circumference (AC) of the obese cynomolgous monkeys studied.
Figure 62:
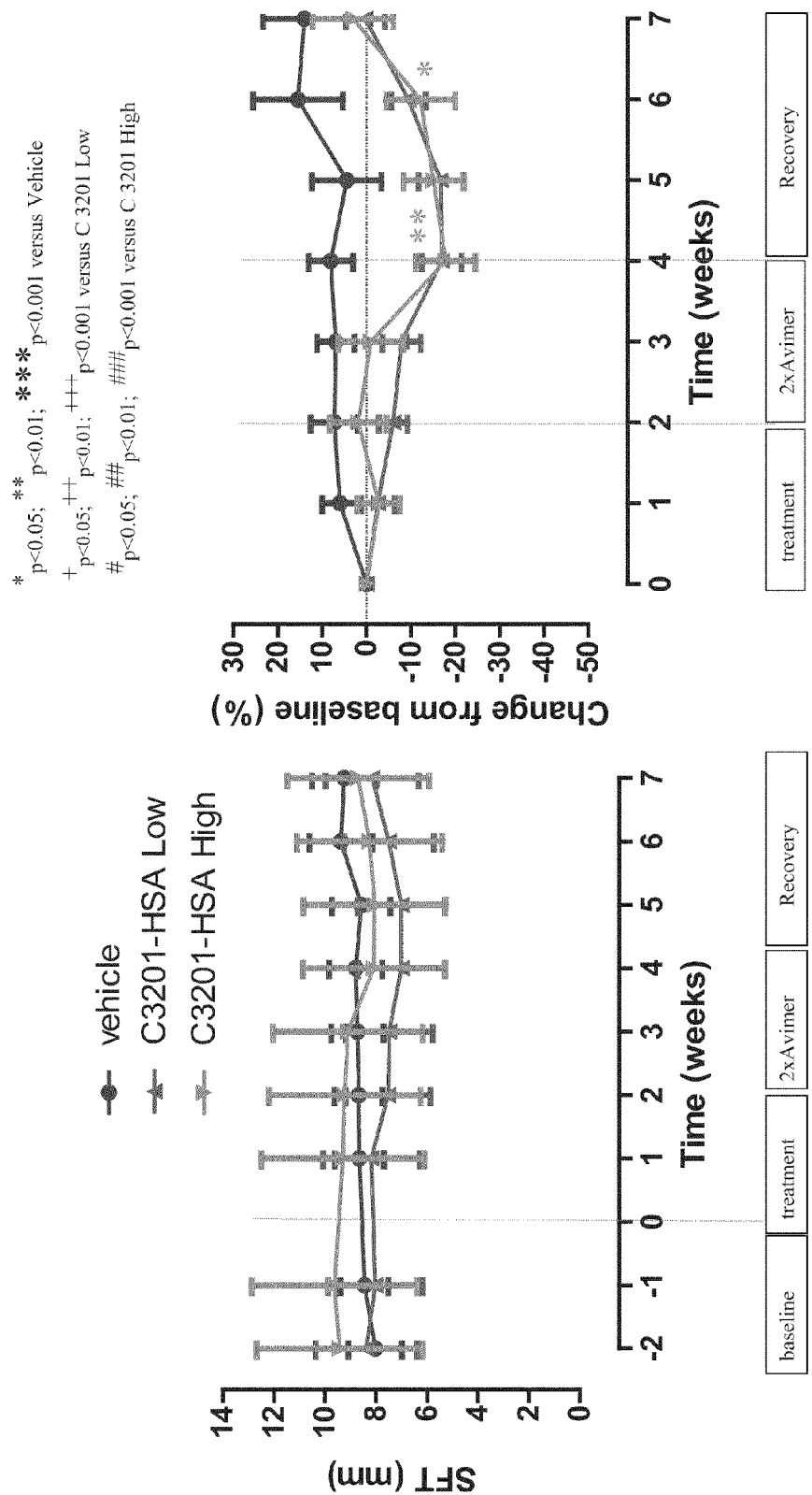
FIG. 62 is a plot showing the effects of vehicle and C3201-HSA (SEQ ID NO: 713) on skin fold thickness (SFT) of the obese cynomolgous monkeys studied.

BMI, AC and SFT were monitored weekly throughout the study, both pre- and post-administration of test compound when the body weight was taken. BMI is defined as the individual's body weight divided by the square of his or her height. SFT is the thickness of a double layer of skin and the fat beneath it as measured with a caliper. BMI, SFT and AC are relatively accurate, simple, and inexpensive measurements of body composition, particularly indicative of subcutaneous fat. Animals treated with vehicle showed relatively stable BMI, SFT and AC throughout the study. Animals treated with C3201-HSA showed decreased levels of BMI, AC and SFT in a dose dependent fashion over the course of the 4 week study, suggesting that C3201-HSA compound resulted in reduction of fat mass. Results for BMI, AC and SFT are shown in FIGS. 60-62, respectively. These measured parameters came back to baseline values at the end of the 6 weeks wash out period.

13.5 Effect of C3201-HSA on Oral Glucose Tolerance Test (OGTT)

Figure 63:
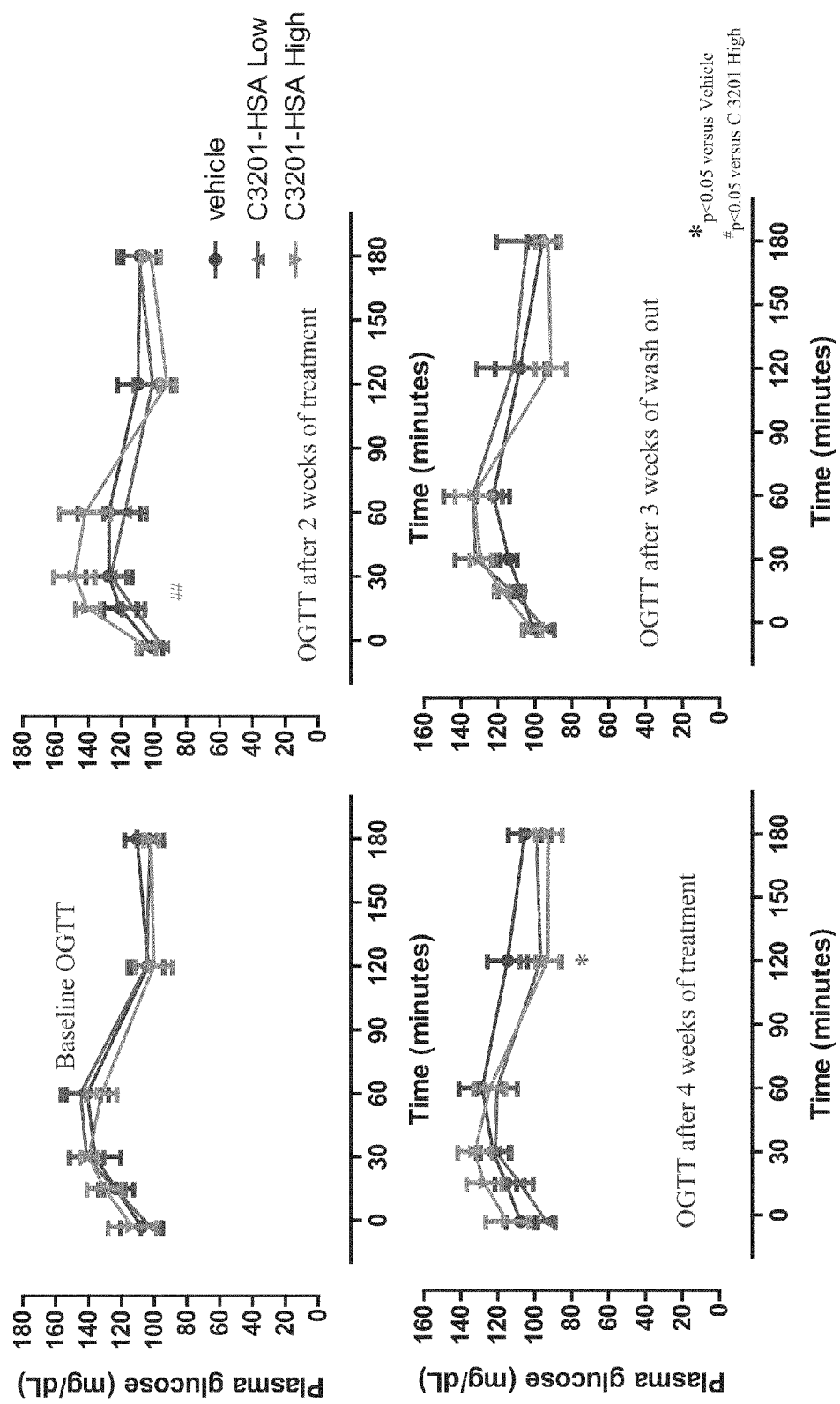
FIG. 63 is a plot showing the effects of vehicle and C3201-HSA (SEQ ID NO: 713) on plasma glucose levels during glucose tolerance tests of the obese cynomolgous monkeys studied.
Figure 64:
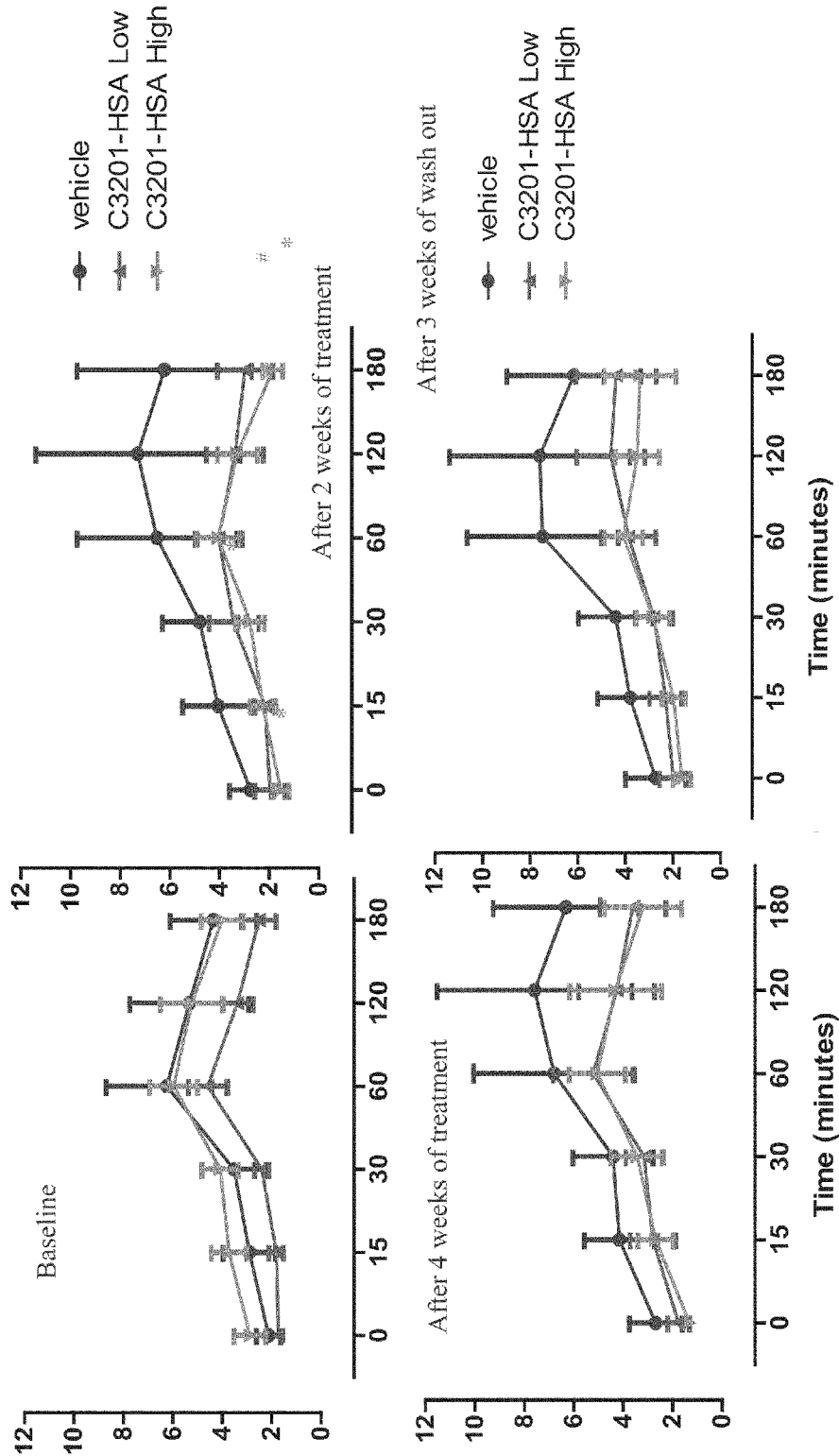
FIG. 64 is a plot showing the effects of vehicle and C3201-HSA (SEQ ID NO: 713) on plasma insulin levels during glucose tolerance tests of the obese cynomolgous monkeys studied.

OGTTs were conducted before and after initiation of treatments. Before C3201-HSA injections baseline values for glucose and insulin levels were measured throughout the OGTT (FIGS. 57 and 58, respectively) and were not statistically significantly different between the vehicle and C3201-HSA groups. Post-dose OGTTs were performed every two weeks during the treatment period and after 3 weeks of wash out period. C3201-HSA high dose slightly improved glucose tolerance after 4 weeks of treatment. The animal model used is not glucose intolerant, explaining the modest effects observed (FIG. 63). Insulin levels were statistically significantly decreased in animals treated with C3201-HSA (significance observed at time 0, 30 and 180 during the OGTT performed after 2 weeks of treatment (FIG. 64).

Figure 65:
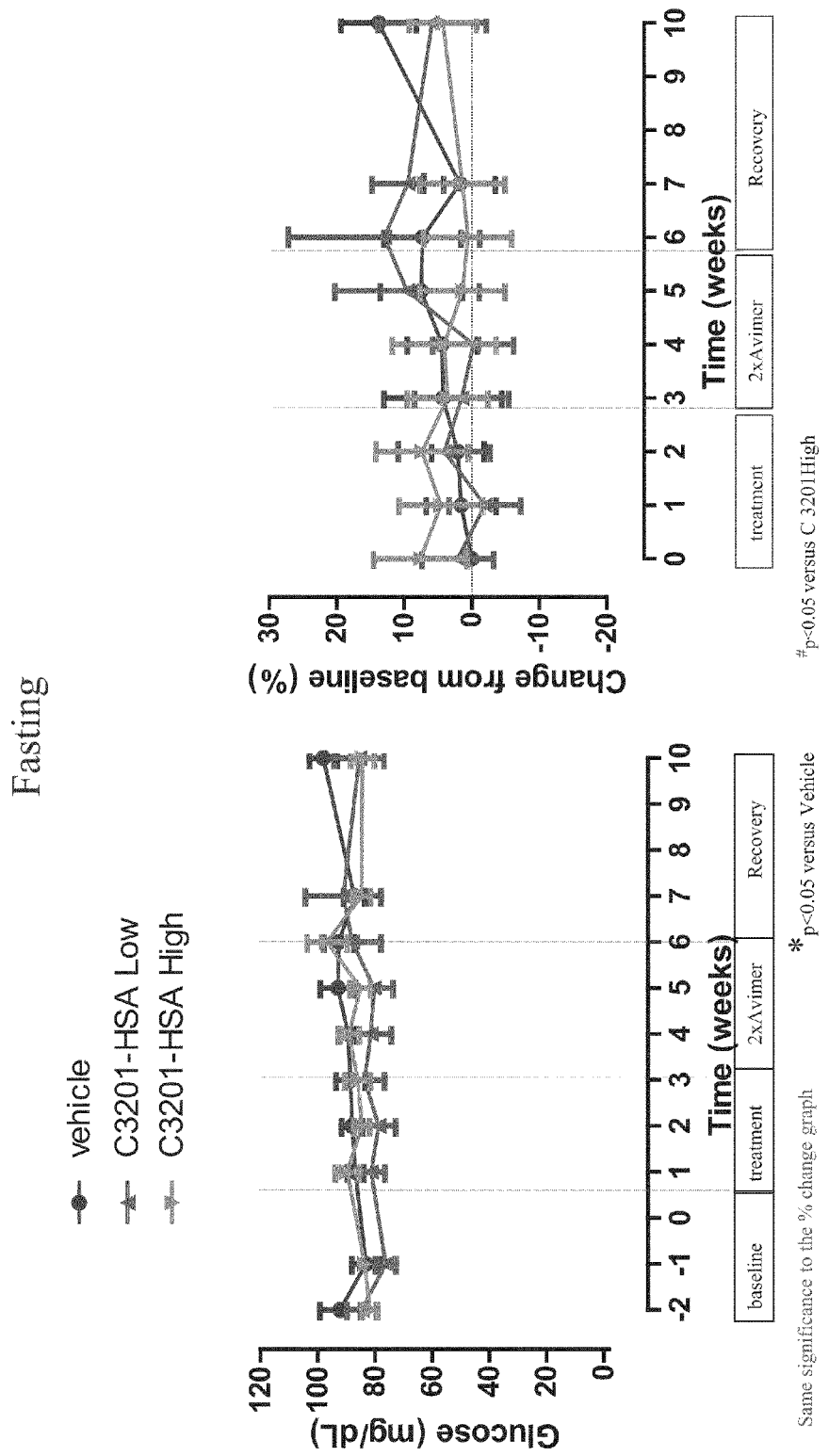
FIG. 65 is a plot showing the effects of vehicle and C3201-HSA (SEQ ID NO: 713) on fasting plasma glucose levels of the obese cynomolgous monkeys studied.
Figure 66:
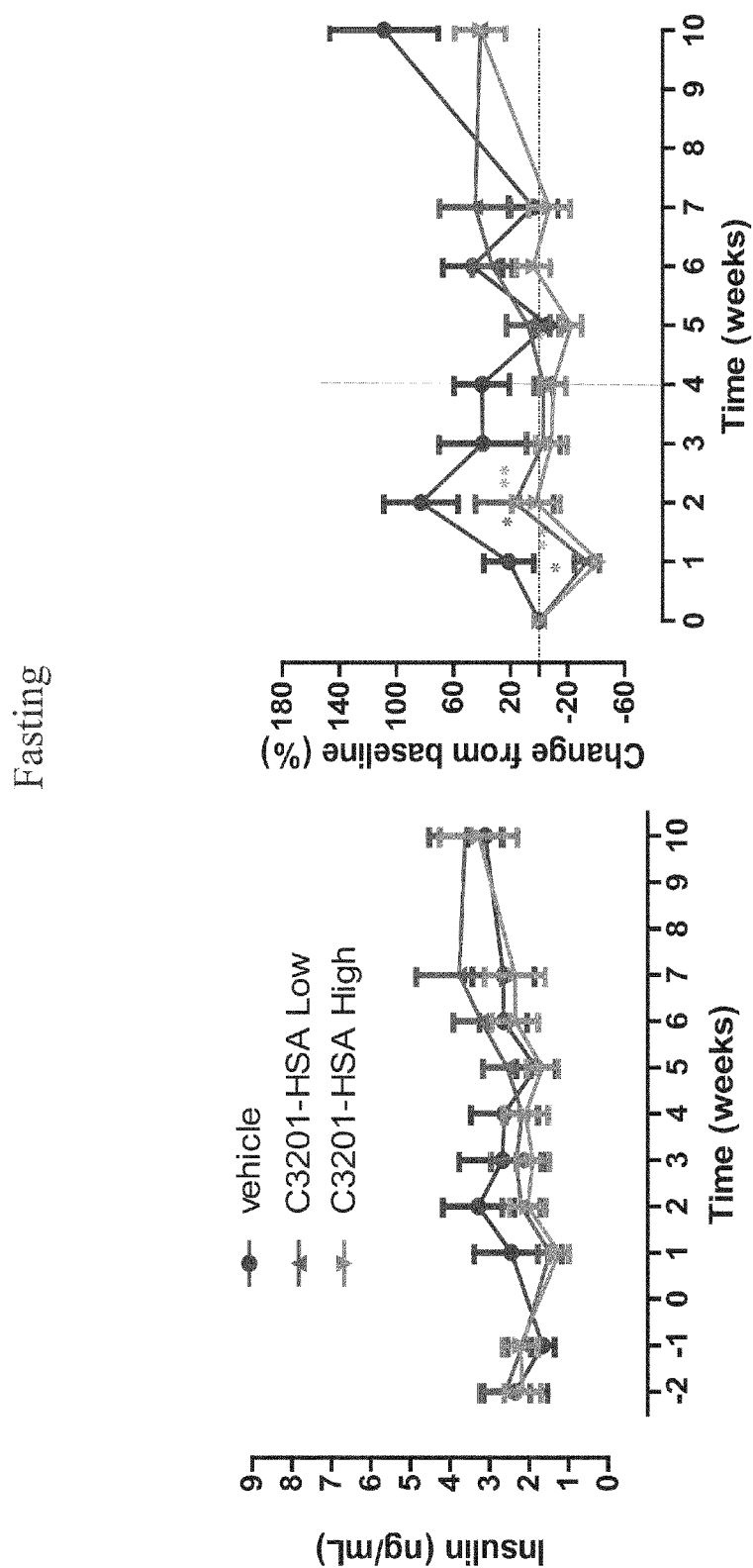
FIG. 66 is a plot showing the effects of vehicle and C3201-HSA (SEQ ID NO: 713) on fasting plasma insulin levels of the obese cynomolgous monkeys studied.

13.6 Effect of C3201-HSA on Fasting and Fed Blood Glucose and Insulin Levels Blood was collected from overnight fasted animals or in fed conditions after the AM feeding. In the fasted conditions, blood drawn was conducted weekly 5 days post each injection. In the fed conditions, blood drawn was conducted on days 2, 11, 16, 25 and 46 post first injection. C3201-HSA did not reduce fasting or fed blood glucose levels (FIG. 65). No hypoglycemia was observed in any of the monkeys treated with C3201-HSA. C3201-HSA did, however, result in a statistically significant decrease in fasting and fed plasma insulin levels (FIG. 66).

13.7 Effect of C3201-HSA on Trigylceride Levels

Figure 67:
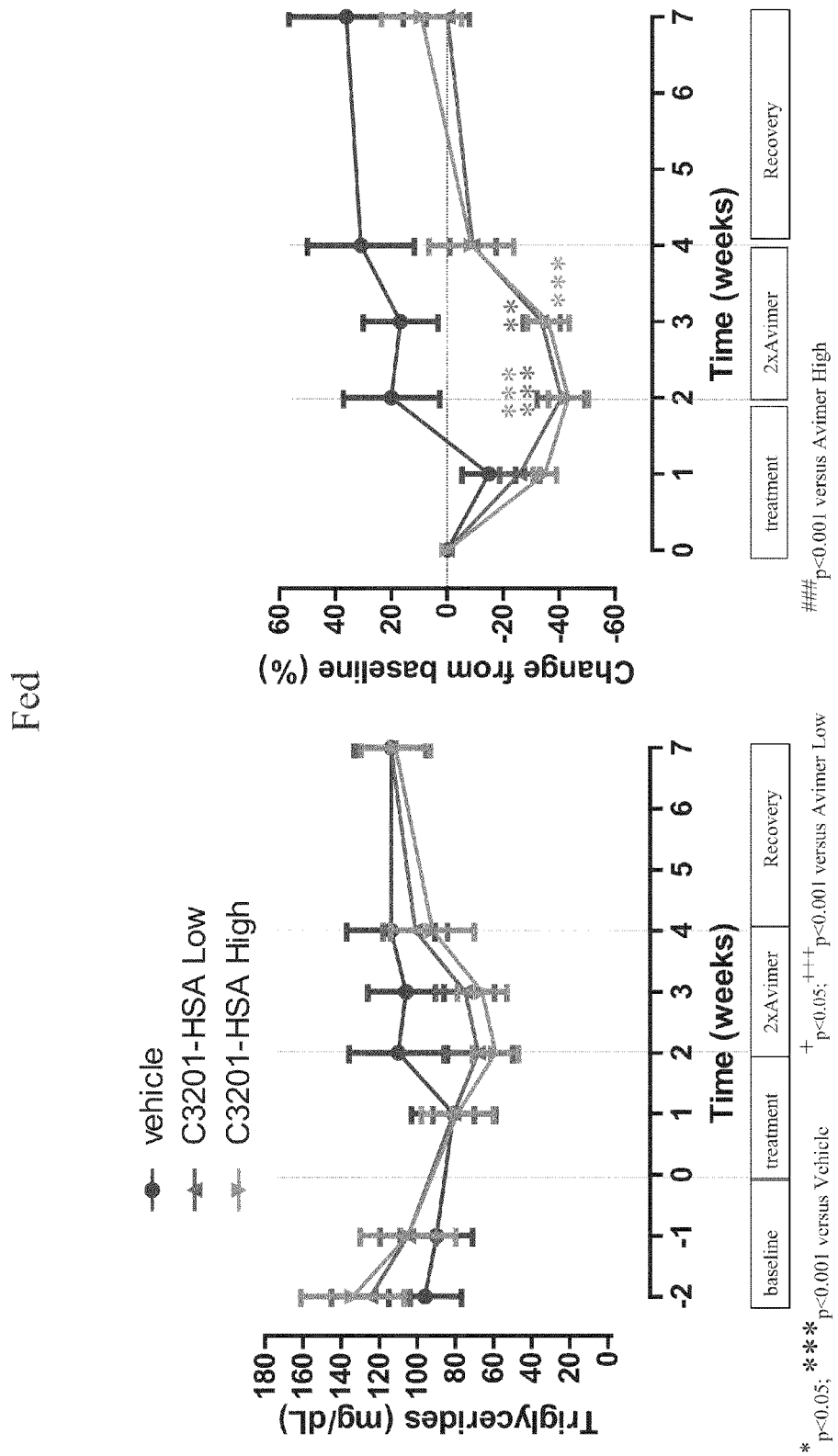
FIG. 67 is a plot showing the effects of vehicle and C3201-HSA (SEQ ID NO: 713) on fed plasma triglyceride levels of the obese cynomolgous monkeys studied.

Measurements were made from the same samples collected for glucose and insulin measurements. Triglyceride levels were significantly reduced in animals treated with C3201-HSA when measured in fed conditions (FIG. 67).

13.8 Conclusions

In a study conducted in male obese cynomolgus monkeys, animals treated with C3201-HSA showed improved metabolic parameters. Body weight was reduced and body composition was improved. Short-term reduction of food intake was observed and the effect diminished and the food intake recovered to baseline or control levels at 21 days into the study. Fasting insulin and fed triglyceride levels were also reduced by C3201-HSA. Insulin levels measured during OGTT were also improved.

SEQUENCE LISTING (1333 sequences)

SEQ ID NO: 1 - protein, 18 aa, Artificial Sequence
  Description of Artificial Sequence: Synthetic peptide
SLQKASGALEHHHHHHHH

SEQ ID NO: 2 - protein, 5 aa, Artificial Sequence
  Description of Artificial Sequence: Synthetic peptide
GGGGS

SEQ ID NO: 3 - protein, 10 aa, Artificial Sequence
  Description of Artificial Sequence: Synthetic peptide
GGGGSGGGGS

SEQ ID NO: 4 - protein, 15 aa, Artificial Sequence
  Description of Artificial Sequence: Synthetic peptide
GGGGSGGGGSGGGGS

SEQ ID NO: 5 - protein, 35 aa, Artificial Sequence
  Description of Artificial Sequence: Synthetic consensus polypeptide
  MOD_RES (2)..(7): Any amino acid
  MOD_RES (9)..(12): Any amino acid
  MOD_RES (14)..(19): Any amino acid
  MOD_RES (21)..(25): Any amino acid
  MOD_RES (27)..(34): Any amino acid
CXXXXXXCXXXXCXXXXXXCXXXXXCXXXXXXXXC

SEQ ID NO: 6 - protein, 4 aa, Artificial Sequence
  Description of Artificial Sequence: Synthetic peptide
ATHT

SEQ ID NO: 7 - protein, 4 aa, Artificial Sequence
  Description of Artificial Sequence: Synthetic peptide
PERT

SEQ ID NO: 8 - protein, 4 aa, Artificial Sequence
  Description of Artificial Sequence: Synthetic peptide
TTRT

SEQ ID NO: 9 - protein, 6 aa, Artificial Sequence
  Description of Artificial Sequence: Synthetic peptide
GTTGPT

SEQ ID NO: 10 - protein, 6 aa, Artificial Sequence
  Description of Artificial Sequence: Synthetic peptide
ETSGPT

SEQ ID NO: 11 - protein, 10 aa, Artificial Sequence
  Description of Artificial Sequence: Synthetic peptide
SQDPEFHKVS

SEQ ID NO: 12 - protein, 11 aa, Artificial Sequence
  Description of Artificial Sequence: Synthetic peptide
SAPASEPPGSL

SEQ ID NO: 13 - protein, 13 aa, Artificial Sequence
  Description of Artificial Sequence: Synthetic peptide
GRPGPGATSAPAA

SEQ ID NO: 14 - protein, 15 aa, Artificial Sequence
  Description of Artificial Sequence: Synthetic peptide
GDSHILPFSTPGPST

SEQ ID NO: 15 - protein, 4 aa, Artificial Sequence
  Description of Artificial Sequence: Synthetic peptide
  MOD_RES (1)..(1): Ala, Glu, Lys, Pro or Thr
  MOD_RES (2)..(2): Ala, Glu, Lys, Leu, Pro or Thr
  MOD_RES (3)..(3): Glu, His, Pro or Arg
XXXT

SEQ ID NO: 16 - protein, 6 aa, Artificial Sequence
  Description of Artificial Sequence: Synthetic peptide
  MOD_RES (1)..(1): Ala, Glu, Lys, Arg or Thr
  MOD_RES (2)..(2): Ala, Gly or Ser
  MOD_RES (3)..(3): Ala, Pro, Ser or Val
  MOD_RES (4)..(4): Ala, Glu, Gly or Val
  MOD_RES (5)..(5): His or Pro
XXXXXT

SEQ ID NO: 17 - protein, 8 aa, Artificial Sequence
  Description of Artificial Sequence: Synthetic peptide
PTKRPEEV

SEQ ID NO: 18 - protein, 9 aa, Artificial Sequence
  Description of Artificial Sequence: Synthetic peptide
SQDPEFHKV

SEQ ID NO: 19 - protein, 46 aa, Artificial Sequence
  Description of Artificial Sequence: Synthetic polypeptide
CLPDEFQCGSGRCIPLTWVCDGLNDCGDGSDESPAHCSQDPEFHKV

SEQ ID NO: 20 - protein, 46 aa, Artificial Sequence
  Description of Artificial Sequence: Synthetic polypeptide
CLPHEFQCGSGRCIPQTWVCDGLNDCGDGSDEWPAQCSQDPEFHKV

SEQ ID NO: 21 - protein, 46 aa, Artificial Sequence
  Description of Artificial Sequence: Synthetic polypeptide
CLPHEFQCRSGRCIPQAWGCDGLNDCGDGSDESPAQCSQDPEFHKV

SEQ ID NO: 22 - protein, 4 aa, Artificial Sequence
  Description of Artificial Sequence: Synthetic peptide
  MOD_RES (1)..(1): Ala, Glu, Pro or Thr
  MOD_RES (2)..(2): Ala, Glu, Pro or Gln
  MOD_RES (3)..(3): His or Pro
XXXT

SEQ ID NO: 23 - protein, 6 aa, Artificial Sequence
  Description of Artificial Sequence: Synthetic peptide
  MOD_RES (1)..(1): Glu, Gly or Thr
  MOD_RES (2)..(2): Ala, Gly or Arg
  MOD_RES (3)..(3): Ala, Ser or Thr
  MOD_RES (4)..(4): Glu, Gly or Val
  MOD_RES (5)..(5): Pro or Arg
XXXXXT

SEQ ID NO: 24 - protein, 6 aa, Artificial Sequence
  Description of Artificial Sequence: Synthetic peptide
KAPVPT

SEQ ID NO: 25 - protein, 9 aa, Artificial Sequence
  Description of Artificial Sequence: Synthetic peptide
SQDPGFHKV

SEQ ID NO: 26 - protein, 4 aa, Artificial Sequence
  Description of Artificial Sequence: Synthetic peptide
  MOD_RES (1)..(1): Ala, Pro or Lys
  MOD_RES (2)..(2): Ala or Thr
  MOD_RES (3)..(3): His, Pro or Arg
XXXT

SEQ ID NO: 27 - protein, 4 aa, Artificial Sequence
  Description of Artificial Sequence: Synthetic peptide
  MOD_RES (1)..(1): Glu or Gln
  MOD_RES (2)..(2): Ala, Arg or Thr
  MOD_RES (3)..(3): His or Pro
XXXT

SEQ ID NO: 28 - protein, 4 aa, Artificial Sequence
  Description of Artificial Sequence: Synthetic peptide
EQRT

SEQ ID NO: 29 - protein, 6 aa, Artificial Sequence
  Description of Artificial Sequence: Synthetic peptide
RRAAHT

SEQ ID NO: 30 - protein, 6 aa, Artificial Sequence
  Description of Artificial Sequence: Synthetic peptide
  MOD_RES (1)..(1): Ala or Lys
  MOD_RES (2)..(2): Ala or Gly
  MOD_RES (3)..(3): Pro or Ser
  MOD_RES (4)..(4): Glu or Gly
  MOD_RES (5)..(5): His or Pro
XXXXXT

SEQ ID NO: 31 - DNA, 630 bp, Homo sapiens
atggactcggacgagaccgggttcgagcactcaggactgtgggtttctgtgctggctggtcttctgctgggagcctgccaggcacaccccatccctgactccagtcctctcctgcaattcgggggccaagtccggcagcggtacctctacacagatgatgcccagcagacagaagcccacctggagatcagggaggatgggacggtggggggcgctgctgaccagagccccgaaagtctcctgcagctgaaagccttgaagccgggagttattcaaatcttgggagtcaagacatccaggttcctgtgccagcggccagatggggccctgtatggatcgctccactttgaccctgaggcctgcagcttccgggagctgcttcttgaggacggatacaatgtttaccagtccgaagcccacggcctcccgctgcacctgccagggaacaagtccccacaccgggaccctgcaccccgaggaccagctcgcttcctgccactaccaggcctgccccccgcacccccggagccacccggaatcctggccccccagccccccgatgtgggctcctcggaccctctgagcatggtgggaccttcccagggccgaagccccagctacgcttcctga

SEQ ID NO: 32 - protein, 209 aa, Homo sapiens [sequence omitted]

SEQ ID NO: 33 - protein, 820 aa, Homo sapiens
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVMTSPLYLEIIIYCTGAFLISCMVGSVIVYKMKSGTKKSDFHSQMAVHKLAKSIPLRRQVTVSADSSASMNSGVLLVRPSRLSSSGTPMLAGVSEYELPEDPRWELPRDRLVLGKPLGEGCFGQVVLAEAIGLDKDKPNRVTKVAVKMLKSDATEKDLSDLISEMEMMKMIGKHKNIINLLGACTQDGPLYVIVEYASKGNLREYLQARRPPGLEYCYNPSHNPEEQLSSKDLVSCAYQVARGMEYLASKKCIHRDLAARNVLVTEDNVMKIADFGLARDIHHIDYYKKTTNGRLPVKWMAPEALFDRIYTHQSDVWSFGVLLWEIFTLGGSPYPGVPVEELFKLLKEGHRMDKPSNCTNELYMMMRDCWHAVPSQRPTFKQLVEDLDRIVALTSNQEYLDLSMPLDQYSPSFPDTRSSTCSSGEDSVFSHEPLPEEPCLPRHPAQLANGGLKRR

SEQ ID NO: 34 - protein, 1044 aa, Homo sapiens
MKPGCAAGSPGNEWIFFSTDEITTRYRNTMSNGGLQRSVILSALILLRAVTGFSGDGRAIWSKNPNFTPVNESQLFLYDTFPKNFFWGIGTGALQVEGSWKKDGKGPSIWDHFIHTHLKNVSSTNGSSDSYIFLEKDLSALDFIGVSFYQFSISWPRLFPDGIVTVANAKGLQYYSTLLDALVLRNIEPIVTLYHWDLPLALQEKYGGWKNDTIIDIFNDYATYCFQMFGDRVKYWITIHNPYLVAWHGYGTGMHAPGEKGNLAAVYTVGHNLIKAHSKVWHNYNTHFRPHQKGWLSITLGSHWIEPNRSENTMDIFKCQQSMVSVLGWFANPIHGDGDYPEGMRKKLFSVLPIFSEAEKHEMRGTADFFAFSFGPNNFKPLNTMAKMGQNVSLNLREALNWIKLEYNNPRILIAENGWFTDSRVKTEDTTAIYMMKNFLSQVLQAIRLDEIRVFGYTAWSLLDGFEWQDAYTIRRGLFYVDFNSKQKERKPKSSAHYYKQIIRENGFSLKESTPDVQGQFPCDFSWGVTESVLKPESVASSPQFSDPHLYVWNATGNRLLHRVEGVRLKTRPAQCTDFVNIKKQLEMLARMKVTHYRFALDWASVLPTGNLSAVNRQALRYYRCVVSEGLKLGISAMVTLYYPTHAHLGLPEPLLHADGWLNPSTAEAFQAYAGLCFQELGDLVKLWITINEPNRLSDIYNRSGNDTYGAAHNLLVAHALAWRLYDRQFRPSQRGAVSLSLHADWAEPANPYADSHWRAAERFLQFEIAWFAEPLFKTGDYPAAMREYIASKHRRGLSSSALPRLTEAERRLLKGTVDFCALNHFTTRFVMHEQLAGSRYDSDRDIQFLQDITRLSSPTRLAVIPWGVRKLLRWVRRNYGDMDIYITASGIDDQALEDDRLRKYYLGKYLQEVLKAYLIDKVRIKGYYAFKLAEEKSKPRFGFFTSDFKAKSSIQFYNKVISSRGFPFENSSSRCSQTQENTECTVCLFLVQKKPLIFLGCCFFSTLVLLLSIAIFQRQKRRKFWKAKNLQHIPLKKGKRVVS

SEQ ID NO: 35 - protein, 27 aa, Artificial Sequence
  Description of Artificial Sequence: Synthetic consensus peptide
  MOD_RES (2)..(2): Val, Ile, Leu, Met or Ala
  MOD_RES (3)..(7): Any amino acid
  MOD_RES (9)..(9): Asp, Asn or His
  MOD_RES (10)..(12): Any amino acid
  MOD_RES (13)..(13): Asp, Glu, Asn, Gln, His or Thr
  MOD_RES (15)..(18): Any amino acid; this region may encompass 3-4 residues
  MOD_RES (19)..(19): Ser, Thr, Ala, Asp or Glu
  MOD_RES (20)..(20): Asp, Glu or His
  MOD_RES (21)..(21): Asp or Glu
  MOD_RES (22)..(26): Any amino acid; this region may encompass 1-5 residues
CXXXXXXCXXXXXCXXXXXXXXXXXXC

SEQ ID NO: 36 - protein, 7 aa, Artificial Sequence
  Description of Artificial Sequence: Synthetic consensus peptide
  MOD_RES (1)..(1): Asp or Glu
  MOD_RES (2)..(6): Any amino acid; this region may encompass 1-5 residues
XXXXXXC

SEQ ID NO: 37 - protein, 64 aa, Artificial Sequence
  Description of Artificial Sequence: Synthetic consensus polypeptide
  MOD_RES (2)..(16): Any amino acid; this region may encompass 3-15 residues
  MOD_RES (18)..(32): Any amino acid; this region may encompass 4-15 residues
  MOD_RES (34)..(40): Any amino acid; this region may encompass 6-7 residues
  MOD_RES (42)..(42): Asn or Asp
  MOD_RES (43)..(45): Any amino acid
  MOD_RES (46)..(46): Asp, Glu, Asn, Gln, His, Ser or Thr
  MOD_RES (48)..(53): Any amino acid; this region may encompass 4-6 residues
  MOD_RES (56)..(63): Any amino acid; this region may encompass 2-8 residues
CXXXXXXXXXXXXXXXCXXXXXXXXXXXXXXXCXXXXXXXCXXXXXCXXXXXXDEXXXXXXXXC

SEQ ID NO: 38 - protein, 64 aa, Artificial Sequence; identical to SEQ ID NO: 37
  Description of Artificial Sequence: Synthetic consensus polypeptide
  MOD_RES (2)..(16): Any amino acid; this region may encompass 3-15 residues
  MOD_RES (18)..(32): Any amino acid; this region may encompass 3-15 residues
  MOD_RES (34)..(40): Any amino acid; this region may encompass 6-7 residues
  MOD_RES (42)..(42): Asp or Asn
  MOD_RES (43)..(46): Any amino acid
  MOD_RES (48)..(53): Any amino acid; this region may encompass 4-6 residues
  MOD_RES (56)..(63): Any amino acid; this region may encompass 2-8 residues

SEQ ID NO: 39 - protein, 68 aa, Artificial Sequence
  Description of Artificial Sequence: Synthetic polypeptide
  MOD_RES (2)..(15): Any amino acid; this region may encompass 3-14 residues
  MOD_RES (17)..(23): Any amino acid; this region may encompass 3-7 residues
  MOD_RES (25)..(40): Any amino acid; this region may encompass 4-16 residues
  MOD_RES (42)..(43): Any amino acid; this region may encompass 1-2 residues
  MOD_RES (45)..(67): Any amino acid; this region may encompass 8-23 residues
CXXXXXXXXXXXXXXCXXXXXXXCXXXXXXXXXXXXXXXXCXXCXXXXXXXXXXXXXXXXXXXXXXXC

SEQ ID NO: 40 - protein, 53 aa, Artificial Sequence
  Description of Artificial Sequence: Synthetic polypeptide
  MOD_RES (1)..(6): Any amino acid; this region may encompass 0-6 residues
  MOD_RES (8)..(10): Any amino acid
  MOD_RES (12)..(16): Any amino acid
  MOD_RES (17)..(17): Any amino acid; this region may encompass 0-1 residues
  MOD_RES (18)..(22): Any amino acid
  MOD_RES (24)..(27): Any amino acid
  MOD_RES (28)..(30): Any amino acid; this region may encompass 0-3 residues
  MOD_RES (31)..(35): Any amino acid
  MOD_RES (37)..(42): Any amino acid
  MOD_RES (43)..(43): Any amino acid; this region may encompass 0-1 residues
  MOD_RES (44)..(46): Any amino acid
  MOD_RES (48)..(48): Any amino acid; this region may encompass 0-1 residues
  MOD_RES (49)..(52): Any amino acid
XXXXXXCXXXCXXXXXXXXXXXCXXXXXXXXXXXXCXXXXXXXXXXCXXXXXC

SEQ ID NO: 41 - protein, 53 aa, Artificial Sequence
  Description of Artificial Sequence: Synthetic polypeptide
  misc_feature (1)..(6): This region may encompass 0-6 residues
  MOD_RES (2)..(3): Any amino acid
  MOD_RES (5)..(6): Any amino acid
  MOD_RES (8)..(10): Any amino acid
  MOD_RES (12)..(13): Any amino acid
  MOD_RES (15)..(16): Any amino acid
  MOD_RES (17)..(17): Any amino acid; this region may encompass 0-1 residues
  MOD_RES (18)..(18): Any amino acid
  MOD_RES (20)..(22): Any amino acid
  MOD_RES (24)..(27): Any amino acid
  misc_feature (28)..(30): This region may encompass 0-3 residues
  MOD_RES (29)..(30): Any amino acid
  MOD_RES (31)..(35): Any amino acid
  MOD_RES (37)..(42): Any amino acid
  MOD_RES (43)..(43): Any amino acid; this region may encompass 0-1 residues
  MOD_RES (44)..(46): Any amino acid
  MOD_RES (48)..(48): Any amino acid; this region may encompass 0-1 residues
  MOD_RES (49)..(52): Any amino acid
WXXWXXCXXXCXXGXXXXRXXXCXXXXPXXXXXXXCXXXXXXXXXXCXXXXXC

SEQ ID NO: 42 - protein, 53 aa, Artificial Sequence
  Description of Artificial Sequence: Synthetic polypeptide
  misc_feature (1)..(6): This region may encompass 0-6 residues
  MOD_RES (2)..(3): Any amino acid
  MOD_RES (5)..(6): Any amino acid
  MOD_RES (9)..(9): Any amino acid
  MOD_RES (12)..(13): Any amino acid
  MOD_RES (15)..(16): Any amino acid
  MOD_RES (17)..(17): Any amino acid; this region may encompass 0-1 residues
  MOD_RES (18)..(18): Any amino acid
  MOD_RES (20)..(20): Any amino acid
  MOD_RES (22)..(22): Any amino acid
  MOD_RES (24)..(27): Any amino acid
  misc_feature (28)..(30): This region may encompass 0-3 residues
  MOD_RES (29)..(30): Any amino acid
  MOD_RES (31)..(35): Any amino acid
  MOD_RES (37)..(42): Any amino acid
  MOD_RES (43)..(43): Any amino acid; this region may encompass 0-1 residues
  MOD_RES (44)..(46): Any amino acid
  MOD_RES (48)..(48): Any amino acid; this region may encompass 0-1 residues
  MOD_RES (49)..(52): Any amino acid
WXXWXXCSXTCXXGXXXXRXRXCXXXXPXXXXXXXCXXXXXXXXXXCXXXXXC

SEQ ID NO: 43 - protein, 53 aa, Artificial Sequence
  Description of Artificial Sequence: Synthetic polypeptide
  misc_feature (1)..(6): This region may encompass 0-6 residues
  MOD_RES (2)..(3): Any amino acid
  MOD_RES (5)..(6): Any amino acid
  MOD_RES (8)..(8): Ser, Thr, Asn or Asp
  MOD_RES (9)..(9): Val, Lys, Ala or Gln
  MOD_RES (10)..(10): Thr, Ser, Pro or Leu
  MOD_RES (12)..(13): Any amino acid
  MOD_RES (14)..(14): Gly or Gln
  MOD_RES (15)..(16): Any amino acid
  MOD_RES (17)..(17): Any amino acid; this region may encompass 0-1 residues
  MOD_RES (18)..(18): Any amino acid
  MOD_RES (19)..(19): Arg or Glu
  MOD_RES (20)..(20): Any amino acid
  MOD_RES (21)..(21): Arg, Lys, Thr, Val or Met
  MOD_RES (22)..(22): Any amino acid
  MOD_RES (23)..(23): Cys, Val, Leu, Asp or Arg
  MOD_RES (24)..(27): Any amino acid
  MOD_RES (28)..(28): Pro or Gln
  misc_feature (28)..(30): This region may encompass 0-3 residues
  MOD_RES (29)..(30): Any amino acid
  MOD_RES (31)..(35): Any amino acid
  MOD_RES (36)..(36): Cys, Leu, Asp, Ala or Glu
  MOD_RES (37)..(42): Any amino acid
  MOD_RES (43)..(43): Any amino acid; this region may encompass 0-1 residues
  MOD_RES (44)..(46): Any amino acid
  MOD_RES (48)..(48): Any amino acid; this region may encompass 0-1 residues
  MOD_RES (49)..(52): Any amino acid
WXXWXXCXXXCXXXXXXXXXXXXXXXXXXXXXXXXXXXXXXXXXXXCXXXXXC

SEQ ID NO: 44 - protein, 53 aa, Artificial Sequence; identical to SEQ ID NO: 43
  Description of Artificial Sequence: Synthetic polypeptide
  misc_feature (1)..(6): This region may encompass 0-6 residues
  MOD_RES (2)..(3): Any amino acid
  MOD_RES (5)..(6): Any amino acid
  MOD_RES (8)..(8): Ser, Thr, Asn or Asp
  MOD_RES (9)..(9): Val, Lys, Ala or Gln
  MOD_RES (10)..(10): Thr, Ser, Pro or Leu
  MOD_RES (12)..(13): Any amino acid
  MOD_RES (14)..(14): Gly or Gln
  MOD_RES (15)..(16): Any amino acid
  MOD_RES (17)..(17): Any amino acid; this region may encompass 0-1 residues
  MOD_RES (18)..(18): Any amino acid
  MOD_RES (19)..(19): Arg or Glu
  MOD_RES (20)..(20): Any amino acid
  MOD_RES (21)..(21): Arg, Lys, Thr, Val or Met
  MOD_RES (22)..(22): Any amino acid
  MOD_RES (23)..(23): Cys, Val, Leu, Asp or Arg
  MOD_RES (24)..(27): Any amino acid
  MOD_RES (28)..(28): Pro or Gln
  misc_feature (28)..(30): This region may encompass 0-3 residues
  MOD_RES (29)..(30): Any amino acid
  MOD_RES (31)..(35): Any amino acid
  MOD_RES (36)..(36): Cys, Leu, Asp, Ala or Glu
  MOD_RES (37)..(42): Any amino acid
  MOD_RES (43)..(43): Any amino acid; this region may encompass 0-1 residues
  MOD_RES (44)..(46): Any amino acid
  MOD_RES (48)..(48): Any amino acid; this region may encompass 0-1 residues
  MOD_RES (49)..(52): Any amino acid

SEQ ID NO: 45 - protein, 50 aa, Artificial Sequence
  Description of Artificial Sequence: Synthetic polypeptide
  MOD_RES (2)..(2): Asn, Ser or Thr
  MOD_RES (3)..(3): Ala, Glu, Gly, Ile, Lys, Leu, Gln, Arg, Ser, Thr or Val
  MOD_RES (4)..(4): Ala, Asp, Glu, Asn, Pro, Gln, Arg, Ser or Thr
  MOD_RES (6)..(6): Ala, Asp, Glu, Thr, Gly or Ser
  MOD_RES (7)..(7): Any amino acid
  MOD_RES (9)..(9): Any amino acid
  MOD_RES (10)..(10): Ile, Lys, Gln, Arg, Ser, Thr or Val
  MOD_RES (11)..(11): Any amino acid
  MOD_RES (12)..(12): Ala, Gln, Arg, Ser or Thr
  MOD_RES (13)..(13): Any amino acid
  MOD_RES (14)..(14): Ala, Leu, Met, Arg, Thr or Val
  MOD_RES (15)..(15): Any amino acid
  MOD_RES (17)..(25): Any amino acid
  MOD_RES (26)..(32): Any amino acid; this region may encompass 0-7 residues
  MOD_RES (34)..(42): Any amino acid
  MOD_RES (43)..(44): Any amino acid; this region may encompass 0-2 residues
  MOD_RES (46)..(49): Any amino acid
CXXXCXXGXXXXXXXCXXXXXXXXXXXXXXXXCXXXXXXXXXXXCXXXXC

SEQ ID NO: 46 - protein, 42 aa, Artificial Sequence
  Description of Artificial Sequence: Synthetic polypeptide
  MOD_RES (2)..(3): Any amino acid; this region may encompass 0-2 residues
  MOD_RES (4)..(12): Any amino acid
  MOD_RES (14)..(15): Any amino acid
  MOD_RES (16)..(16): Any amino acid; this region may encompass 0-1 residues
  MOD_RES (17)..(23): Any amino acid
  MOD_RES (25)..(28): Any amino acid
  MOD_RES (31)..(35): Any amino acid
  MOD_RES (36)..(36): Any amino acid; this region may encompass 0-1 residues
  MOD_RES (37)..(41): Any amino acid
CXXXXXXXXXXXCXXXXXXXXXXCXXXXCCXXXXXXXXXXXC

SEQ ID NO: 47 - protein, 42 aa, Artificial Sequence
  Description of Artificial Sequence: Synthetic polypeptide
  MOD_RES (2)..(3): Any amino acid; this region may encompass 0-2 residues
  MOD_RES (4)..(9): Any amino acid
  MOD_RES (11)..(12): Any amino acid
  MOD_RES (14)..(15): Any amino acid
  MOD_RES (16)..(16): Any amino acid; this region may encompass 0-1 residues
  MOD_RES (17)..(23): Any amino acid
  MOD_RES (25)..(28): Any amino acid
  MOD_RES (31)..(35): Any amino acid
  MOD_RES (36)..(36): Any amino acid; this region may encompass 0-1 residues
  MOD_RES (37)..(41): Any amino acid
CXXXXXXXXRXXCXXXXXXXXXXCXXXXCCXXXXXXXXXXXC

SEQ ID NO: 48 - protein, 43 aa, Artificial Sequence
  Description of Artificial Sequence: Synthetic polypeptide
  MOD_RES (2)..(3): Any amino acid; this region may encompass 0-2 residues
  MOD_RES (4)..(6): Any amino acid
  MOD_RES (8)..(9): Any amino acid
  MOD_RES (11)..(11): Any amino acid
  MOD_RES (15)..(15): Any amino acid
  MOD_RES (16)..(16): Any amino acid; this region may encompass 0-1 residues
  MOD_RES (18)..(18): Any amino acid
  MOD_RES (21)..(23): Any amino acid
  MOD_RES (25)..(27): Any amino acid
  MOD_RES (33)..(35): Any amino acid
  MOD_RES (36)..(36): Any amino acid; this region may encompass 0-1 residues
  MOD_RES (37)..(39): Any amino acid
CXXXXXPXXRXNCGXXPXITXXXCXXXGCCFDXXXXXXXPWCF

SEQ ID NO: 49 - protein, 44 aa, Artificial Sequence
  Description of Artificial Sequence: Synthetic polypeptide
  MOD_RES (2)..(3): Any amino acid; this region may encompass 0-2 residues
  MOD_RES (4)..(6): Any amino acid
  MOD_RES (7)..(7): Pro, Val, Ala or Glu
  MOD_RES (8)..(9): Any amino acid
  MOD_RES (11)..(11): Any amino acid
  MOD_RES (12)..(12): Asn, Asp, Pro or Met
  MOD_RES (14)..(14): Gly, Ala, Ile or Tyr
  MOD_RES (15)..(15): Tyr, Pro, Phe, Ser or Thr
  MOD_RES (16)..(16): Asp or Glu
  misc_feature (16)..(17): This region may encompass 0-2 residues
  MOD_RES (17)..(17): Any amino acid
  MOD_RES (18)..(18): Pro, Ser, Lys or Gln
  MOD_RES (19)..(19): Any amino acid
  MOD_RES (20)..(20): Ile, Val, Ala or Pro
  MOD_RES (21)..(21): Thr, Ser or Ala
  MOD_RES (22)..(23): Any amino acid
  MOD_RES (24)..(24): Gln, Glu, Asp or Lys
  MOD_RES (26)..(27): Any amino acid
  MOD_RES (28)..(28): Lys, Arg, Leu or Asn
  MOD_RES (29)..(29): Gly, Asn or Lys
  MOD_RES (32)..(32): Phe, Trp or Tyr
  MOD_RES (33)..(33): Asp, Asn, Arg or Ser
  MOD_RES (34)..(34): Ser, Asp, Pro, Asn, Thr or Glu
  MOD_RES (35)..(36): Any amino acid
  MOD_RES (37)..(37): Any amino acid; this region may encompass 0-1 residues
  MOD_RES (38)..(40): Any amino acid
  MOD_RES (41)..(41): Pro, Lys or Ile
  MOD_RES (42)..(42): Trp, Glu, Ala, Ser or His
  MOD_RES (44)..(44): Phe or Tyr
CXXXXXXXXRXXCXXXXXXXXXXXCXXXXCCXXXXXXXXXXXCX

SEQ ID NO: 50 - protein, 44 aa, Artificial Sequence; identical to SEQ ID NO: 49
  Description of Artificial Sequence: Synthetic polypeptide
  MOD_RES (2)..(3): Any amino acid; this region may encompass 0-2 residues
  MOD_RES (4)..(6): Any amino acid
  MOD_RES (7)..(7): Pro, Val, Ala or Glu
  MOD_RES (8)..(9): Any amino acid
  MOD_RES (11)..(11): Any amino acid
  MOD_RES (12)..(12): Asn, Asp, Pro or Met
  MOD_RES (14)..(14): Gly, Ala, Ile or Tyr
  MOD_RES (15)..(15): Tyr, Pro, Phe, Ser or Thr
  MOD_RES (16)..(16): Asp or Glu
  misc_feature (16)..(17): This region may encompass 0-2 residues
  MOD_RES (17)..(17): Any amino acid
  MOD_RES (18)..(18): Pro, Ser, Lys or Gln
  MOD_RES (19)..(19): Any amino acid
  MOD_RES (20)..(20): Ile, Val, Ala or Pro
  MOD_RES (21)..(21): Thr, Ser or Ala
  MOD_RES (22)..(23): Any amino acid
  MOD_RES (24)..(24): Lys, Glu, Gln or Asp
  MOD_RES (26)..(27): Any amino acid
  MOD_RES (28)..(28): Lys, Arg, Leu or Asn
  MOD_RES (29)..(29): Gly, Asn or Lys
  MOD_RES (32)..(32): Any aromatic/hydrophobic amino acid
  MOD_RES (33)..(33): Asp, Asn, Arg or Ser
  MOD_RES (34)..(34): Ser, Asp, Pro, Asn, Thr or Glu
  MOD_RES (35)..(36): Any amino acid
  MOD_RES (37)..(37): Any amino acid; this region may encompass 0-1 residues
  MOD_RES (38)..(40): Any amino acid
  MOD_RES (41)..(41): Pro, Lys or Ile
  MOD_RES (42)..(42): Trp, Glu, Ala, Ser or His
  MOD_RES (44)..(44): Phe or Tyr

SEQ ID NO: 51 - protein, 38 aa, Artificial Sequence
  Description of Artificial Sequence: Synthetic polypeptide
  MOD_RES (2)..(2): Asp, Asn, Pro or Ser
  misc_feature (2)..(2): This region may encompass 0-1 residues
  MOD_RES (3)..(3): Ala, Asp, Ile, Lys, Leu, Asn, Pro, Arg, Ser, Thr or Val
  MOD_RES (4)..(4): Asp, Phe, Ile, Leu, Met or Val
  MOD_RES (5)..(5): Ala, Asp, Glu, Asn, Pro, Arg, Ser or Thr
  MOD_RES (6)..(6): Ala, Asp, Glu, Leu, Pro, Arg or Val
  MOD_RES (7)..(7): Glu, His, Lys, Leu, Asn, Gln, Arg or Ser
  MOD_RES (8)..(8): Ala, Asp, Glu, Gly, Lys, Asn, Ser or Val
  MOD_RES (9)..(9): Lys, Gln or Arg
  MOD_RES (10)..(10): Phe, Ile, Lys, Leu, Gln, Arg, Thr or Val
  MOD_RES (11)..(11): Asp, Asn, Pro, Gln or Ser
  MOD_RES (13)..(13): Ala, Gly, Ile or Tyr
  MOD_RES (14)..(14): Phe, Leu, Pro, Ser, Val or Tyr
  MOD_RES (15)..(15): Asp, Lys, Asn, Pro, Gln or Ser
  MOD_RES (16)..(16): Ala, Asp, Phe, Gly, His, Leu or Pro
  MOD_RES (17)..(17): Ala, Ile, Pro or Val
  MOD_RES (18)..(18): Ser or Thr
  MOD_RES (19)..(19): Ala, Glu, Gly, Lys, Pro, Gln, Arg or Ser
  MOD_RES (20)..(20): Ala, Asp, Glu, Gly, Lys, Pro, Gln or Ser
  MOD_RES (21)..(21): Asp, Glu, Ile, Lys, Asn, Gln or Thr
  MOD_RES (23)..(23): Ala, Asp, Glu, Phe, Lys, Asn, Gln, Arg or Thr
  MOD_RES (24)..(24): Ala, Asp, Glu, Gly, Lys, Asn, Gln or Ser
  MOD_RES (25)..(25): Gly or Asn
  MOD_RES (28)..(28): Trp, Tyr, Phe or His
  MOD_RES (29)..(29): Asp, Glu, Ile, Asn, Arg or Ser
  MOD_RES (30)..(30): Ala, Asp, Gly, Asn, Pro, Ser or Thr
  MOD_RES (31)..(31): Ala, Glu, Phe, Gly, Gln, Leu, Arg, Ser, Thr or Trp
  MOD_RES (32)..(32): Gly, Ile, Lys, Asn, Ser, Val, Met or Gln
  MOD_RES (33)..(33): Ala, Phe, Met, Pro, Arg, Ser, Thr or Val
  misc_feature (33)..(37): This region may encompass 0-5 residues
  MOD_RES (34)..(34): Asp, Glu, Gly, Lys, Leu, Asn or Ser
  MOD_RES (35)..(35): Ala, Phe, Ile, Gln, Ser, Thr or Val
  MOD_RES (36)..(36): Ile, Lys, Asn, Pro or Val
CXXXXXXXXXXCXXXXXXXXXCXXXCCXXXXXXXXXWC

SEQ ID NO: 52 - protein, 85 aa, Artificial Sequence
  Description of Artificial Sequence: Synthetic polypeptide
  MOD_RES (2)..(16): Any amino acid
  MOD_RES (17)..(26): Any amino acid; this region may encompass 0-10 residues
  MOD_RES (27)..(37): Any amino acid
  MOD_RES (39)..(48): Any amino acid
  MOD_RES (50)..(50): Any amino acid
  MOD_RES (51)..(51): Any amino acid; this region may encompass 0-1 residues
  MOD_RES (52)..(52): Any amino acid
  MOD_RES (53)..(55): Any amino acid; this region may encompass 0-3 residues
  MOD_RES (56)..(59): Any amino acid
  MOD_RES (61)..(61): Any amino acid
  MOD_RES (63)..(66): Any amino acid
  MOD_RES (67)..(67): Any amino acid; this region may encompass 0-1 residues
  MOD_RES (68)..(81): Any amino acid
  MOD_RES (82)..(83): Any amino acid; this region may encompass 0-2 residues
  MOD_RES (84)..(84): Any amino acid
CXXXXXXXXXXXXXXXXXXXXXXXXXXXXXXXXXXXXCXXXXXXXXXXCXXXXXXXXXXCXCXXXXXXXXXXXXXXXXXXXXXXC

SEQ ID NO: 53 - protein, 85 aa, Artificial Sequence
  Description of Artificial Sequence: Synthetic polypeptide
  MOD_RES (2)..(16): Any amino acid
  MOD_RES (17)..(26): Any amino acid; this region may encompass 0-10 residues
  MOD_RES (27)..(33): Any amino acid
  MOD_RES (35)..(35): Any amino acid
  MOD_RES (37)..(37): Any amino acid
  MOD_RES (39)..(41): Any amino acid
  MOD_RES (43)..(47): Any amino acid
  MOD_RES (50)..(50): Any amino acid
  MOD_RES (51)..(51): Any amino acid; this region may encompass 0-1 residues
  MOD_RES (52)..(52): Any amino acid
  MOD_RES (53)..(55): Any amino acid; this region may encompass 0-3 residues
  MOD_RES (56)..(59): Any amino acid
  MOD_RES (64)..(66): Any amino acid
  MOD_RES (67)..(67): Any amino acid; this region may encompass 0-1 residues
  MOD_RES (69)..(72): Any amino acid
  MOD_RES (74)..(81): Any amino acid
  MOD_RES (82)..(83): Any amino acid; this region may encompass 0-2 residues
  MOD_RES (84)..(84): Any amino acid
CXXXXXXXXXXXXXXXXXXXXXXXXXXXXXXXXYXPXCXXXGXXXXXQCXXXXXXXXXXCWCVXXXXGXXXXGXXXXXXXXXXXC

SEQ ID NO: 54 - protein, 85 aa, Artificial Sequence
  Description of Artificial Sequence: Synthetic polypeptide
  MOD_RES (2)..(16): Any amino acid
  MOD_RES (17)..(26): Any amino acid; this region may encompass 0-10 residues
  MOD_RES (27)..(33): Any amino acid
  MOD_RES (35)..(35): Any amino acid
  MOD_RES (37)..(37): Any amino acid
  MOD_RES (39)..(41): Any amino acid
  MOD_RES (43)..(43): Any amino acid
  MOD_RES (45)..(47): Any amino acid
  MOD_RES (50)..(50): Any amino acid
  MOD_RES (51)..(51): Any amino acid; this region may encompass 0-1 residues
  MOD_RES (53)..(55): Any amino acid; this region may encompass 0-3 residues
  MOD_RES (56)..(57): Any amino acid
  MOD_RES (59)..(59): Any amino acid
  MOD_RES (65)..(66): Any amino acid
  MOD_RES (67)..(67): Any amino acid; this region may encompass 0-1 residues
  MOD_RES (69)..(72): Any amino acid
  MOD_RES (74)..(78): Any amino acid
  MOD_RES (80)..(81): Any amino acid
  MOD_RES (82)..(83): Any amino acid; this region may encompass 0-2 residues
  MOD_RES (84)..(84): Any amino acid
CXXXXXXXXXXXXXXXXXXXXXXXXXXXXXXXXYXPXCXXXGXYXXXQCXXSXXXXXGXCWCVDXXXGXXXXGXXXXXGXXXXXC

SEQ ID NO: 55 - protein, 85 aa, Artificial Sequence
  Description of Artificial Sequence: Synthetic polypeptide
  MOD_RES (2)..(2): Gln, Glu, Arg or Leu
  MOD_RES (3)..(16): Any amino acid
  MOD_RES (17)..(26): Any amino acid; this region may encompass 0-10 residues
  MOD_RES (27)..(33): Any amino acid
  MOD_RES (34)..(34): Tyr, Phe, His or Pro
  MOD_RES (35)..(35): Any amino acid
  MOD_RES (37)..(37): Any amino acid
  MOD_RES (39)..(41): Any amino acid
  MOD_RES (43)..(43): Any amino acid
  MOD_RES (44)..(44): Tyr or Phe
  MOD_RES (45)..(46): Any amino acid
  MOD_RES (47)..(47): Val, Lys, Arg or Leu
  MOD_RES (50)..(50): Any amino acid
  MOD_RES (51)..(51): Any amino acid
  MOD_RES (51)..(55): Any amino acid; this region may encompass 0-5 residues
  MOD_RES (52)..(52): Ser or Ala
  MOD_RES (53)..(55): Any amino acid
  MOD_RES (56)..(57): Any amino acid
  MOD_RES (58)..(58): Gly, Ser or Ala
  MOD_RES (59)..(59): Any amino acid
  MOD_RES (61)..(61): Trp, Tyr or Phe
  MOD_RES (64)..(64): Asp, Asn, Tyr, Phe or Leu
  MOD_RES (65)..(66): Any amino acid
  MOD_RES (67)..(67): Any amino acid; this region may encompass 0-1 residues
  MOD_RES (69)..(72): Any amino acid
  MOD_RES (73)..(73): Gly, Asp, Asn or Glu
  MOD_RES (74)..(78): Any amino acid
  MOD_RES (80)..(81): Any amino acid
  MOD_RES (82)..(83): Any amino acid; this region may encompass 0-2 residues
  MOD_RES (84)..(84): Any amino acid
CXXXXXXXXXXXXXXXXXXXXXXXXXXXXXXXXXXPXCXXXGXXXXXQCXXXXXXXXXXCXCVXXXXGXXXXXXXXXXGXXXXXC

SEQ ID NO: 56 - protein, 85 aa, Artificial Sequence; identical to SEQ ID NO: 55
  Description of Artificial Sequence: Synthetic polypeptide
  MOD_RES (2)..(2): Gln, Glu, Arg or Leu
  MOD_RES (3)..(16): Any amino acid
  MOD_RES (17)..(26): Any amino acid; this region may encompass 0-10 residues
  MOD_RES (27)..(33): Any amino acid
  MOD_RES (34)..(34): Any aromatic/hydrophobic amino acid, His or Pro
  MOD_RES (35)..(35): Any amino acid
  MOD_RES (37)..(37): Any amino acid
  MOD_RES (39)..(41): Any amino acid
  MOD_RES (43)..(43): Any amino acid
  MOD_RES (44)..(44): Any aromatic/hydrophobic amino acid
  MOD_RES (45)..(46): Any amino acid
  MOD_RES (47)..(47): Val, Lys, Arg or Leu
  MOD_RES (50)..(50): Any amino acid
  MOD_RES (51)..(51): Any amino acid
  MOD_RES (52)..(52): Ser or Ala
  MOD_RES (53)..(55): Any amino acid
  misc_feature (51)..(55): This region may encompass 0-5 residues
  MOD_RES (56)..(57): Any amino acid
  MOD_RES (58)..(58): Gly, Ala or Ser
  MOD_RES (59)..(59): Any amino acid
  MOD_RES (61)..(61): Any aromatic/hydrophobic amino acid
  MOD_RES (64)..(64): Asp, Asn or any aromatic/hydrophobic amino acid
  MOD_RES (65)..(66): Any amino acid
  MOD_RES (67)..(67): Any amino acid; this region may encompass 0-1 residues
  MOD_RES (69)..(72): Any amino acid
  MOD_RES (73)..(73): Any negatively charged amino acid or Gly
  MOD_RES (74)..(78): Any amino acid
  MOD_RES (80)..(81): Any amino acid
  MOD_RES (82)..(83): Any amino acid; this region may encompass 0-2 residues
  MOD_RES (84)..(84): Any amino acid

SEQ ID NO: 57 - protein, 61 aa, Artificial Sequence
  Description of Artificial Sequence: Synthetic polypeptide
  MOD_RES (2)..(2): Any amino acid
  MOD_RES (4)..(9): Any amino acid
  MOD_RES (10)..(12): Any amino acid; this region may encompass 0-3 residues
  MOD_RES (13)..(14): Any amino acid
  MOD_RES (16)..(18): Any amino acid
  MOD_RES (19)..(24): Any amino acid; this region may encompass 0-6 residues
  MOD_RES (25)..(28): Any amino acid
  MOD_RES (30)..(30): Any amino acid
  MOD_RES (32)..(39): Any amino acid
  MOD_RES (41)..(42): Any amino acid
  MOD_RES (44)..(50): Any amino acid
  MOD_RES (51)..(55): Any amino acid; this region may encompass 0-5 residues
  MOD_RES (56)..(60): Any amino acid
CXCXXXXXXXXXXXCXXXXXXXXXXXXXCXCXXXXXXXXCXXCXXXXXXXXXXXXXXXXXC

SEQ ID NO: 58 - protein, 61 aa, Artificial Sequence
  Description of Artificial Sequence: Synthetic polypeptide
  MOD_RES (2)..(2): Any amino acid
  MOD_RES (4)..(9): Any amino acid
  MOD_RES (10)..(12): Any amino acid; this region may encompass 0-3 residues
  MOD_RES (13)..(14): Any amino acid
  MOD_RES (16)..(18): Any amino acid
  MOD_RES (19)..(24): Any amino acid; this region may encompass 0-6 residues
  MOD_RES (25)..(26): Any amino acid
  MOD_RES (28)..(28): Any amino acid
  MOD_RES (30)..(30): Any amino acid
  MOD_RES (32)..(36): Any amino acid
  MOD_RES (38)..(39): Any amino acid
  MOD_RES (41)..(42): Any amino acid
  MOD_RES (44)..(50): Any amino acid
  MOD_RES (51)..(55): Any amino acid; this region may encompass 0-5 residues
  MOD_RES (56)..(60): Any amino acid
CXCXXXXXXXXXXXCXXXXXXXXXXXGXCXCXXXXXGXXCXXCXXXXXXXXXXXXXXXXXC

SEQ ID NO: 59 - protein, 61 aa, Artificial Sequence; identical to SEQ ID NO: 58
  Description of Artificial Sequence: Synthetic polypeptide
  MOD_RES (2)..(2): Any amino acid
  MOD_RES (4)..(4): Asn, Asp or His
  MOD_RES (5)..(9): Any amino acid
  MOD_RES (10)..(12): Any amino acid; this region may encompass 0-3 residues
  MOD_RES (13)..(14): Any amino acid
  MOD_RES (16)..(18): Any amino acid
  MOD_RES (19)..(24): Any amino acid; this region may encompass 0-6 residues
  MOD_RES (25)..(26): Any amino acid
  MOD_RES (28)..(28): Any amino acid
  MOD_RES (30)..(30): Any amino acid
  MOD_RES (32)..(36): Any amino acid
  MOD_RES (38)..(39): Any amino acid
  MOD_RES (41)..(41): Asp, Glu, Asn or Gln
  MOD_RES (42)..(42): Any amino acid
  MOD_RES (44)..(45): Any amino acid
  MOD_RES (46)..(46): Gly or Asn
  MOD_RES (47)..(47): Tyr, Phe, His or Thr
  MOD_RES (48)..(50): Any amino acid
  MOD_RES (51)..(55): Any amino acid; this region may encompass 0-5 residues
  MOD_RES (56)..(60): Any amino acid

SEQ ID NO: 60 - protein, 57 aa, Artificial Sequence
  Description of Artificial Sequence: Synthetic polypeptide
  MOD_RES (2)..(2): Any amino acid
  MOD_RES (6)..(7): Any amino acid
  MOD_RES (8)..(9): Any amino acid; this region may encompass 0-2 residues
  MOD_RES (10)..(13): Any amino acid
  MOD_RES (15)..(15): Any amino acid
  MOD_RES (16)..(17): Any amino acid; this region may encompass 0-2 residues
  MOD_RES (18)..(22): Any amino acid
  MOD_RES (24)..(24): Any amino acid
  MOD_RES (26)..(27): Any amino acid
  MOD_RES (29)..(29): Any amino acid
  MOD_RES (31)..(31): Any amino acid
  MOD_RES (33)..(33): Any amino acid
  MOD_RES (34)..(36): Any amino acid; this region may encompass 0-3 residues
  MOD_RES (37)..(37): Any amino acid
  MOD_RES (39)..(40): Any amino acid
  MOD_RES (42)..(48): Any amino acid
  MOD_RES (49)..(53): Any amino acid; this region may encompass 0-5 residues
  MOD_RES (54)..(56): Any amino acid
DXDECXXXXXXXXCXXXXXXXXCXNXXGXFXCXXXXXCXXGXXXXXXXXXXXXXXXC

SEQ ID NO: 61 - protein, 34 aa, Artificial Sequence
  Description of Artificial Sequence: Synthetic polypeptide
  MOD_RES (2)..(3): Any amino acid
  MOD_RES (4)..(5): Any amino acid; this region may encompass 0-2 residues
  MOD_RES (6)..(8): Any amino acid
  MOD_RES (10)..(14): Any amino acid
  MOD_RES (17)..(17): Any amino acid
  MOD_RES (19)..(21): Any amino acid
  MOD_RES (24)..(26): Any amino acid
  MOD_RES (28)..(29): Any amino acid
  MOD_RES (32)..(32): Any amino acid
CXXXXXXXCXXXXXNGXCXXXCNXXXCXXDGXDC

SEQ ID NO: 62 - protein, 43 aa, Artificial Sequence
  Description of Artificial Sequence: Synthetic polypeptide
  MOD_RES (2)..(4): Any amino acid
  MOD_RES (8)..(9): Any amino acid
  MOD_RES (11)..(12): Any amino acid
  MOD_RES (15)..(18): Any amino acid
  MOD_RES (20)..(22): Any amino acid
  MOD_RES (24)..(25): Any amino acid
  MOD_RES (27)..(29): Any amino acid
  MOD_RES (31)..(33): Any amino acid
  MOD_RES (35)..(36): Any amino acid
  MOD_RES (39)..(39): Any amino acid
  MOD_RES (41)..(42): Any amino acid
CXXXYYGXXCXXFCXXXXDXXXHXXCXXXGXXXCXXGWXGXXC

SEQ ID NO: 63 - protein, 38 aa, Artificial Sequence
  Description of Artificial Sequence: Synthetic polypeptide
  MOD_RES (3)..(3): Any amino acid
  MOD_RES (6)..(10): Any amino acid
  MOD_RES (11)..(11): Any amino acid; this region may encompass 0-1 residues
  MOD_RES (12)..(15): Any amino acid
  MOD_RES (18)..(18): Any amino acid
  MOD_RES (20)..(25): Any amino acid
  MOD_RES (26)..(27): Any amino acid; this region may encompass 0-2 residues
  MOD_RES (28)..(29): Any amino acid
  MOD_RES (31)..(33): Any amino acid
  MOD_RES (35)..(36): Any amino acid
CCXDGXXXXXXXXXXCEXRXXXXXXXXXXCXXXFXXCC

SEQ ID NO: 64 - protein, 57 aa, Artificial Sequence
  Description of Artificial Sequence: Synthetic polypeptide
  MOD_RES (2)..(2): Any hydrophobic amino acid
  MOD_RES (3)..(3): Asp or Asn
  MOD_RES (6)..(7): Any amino acid
  MOD_RES (8)..(9): Any amino acid; this region may encompass 0-2 residues
  MOD_RES (10)..(13): Any amino acid
  MOD_RES (15)..(15): Pro, Asp or Gly
  misc_feature (16)..(17): This region may encompass 0-2 residues
  MOD_RES (17)..(17): Any amino acid
  MOD_RES (18)..(22): Any amino acid
  MOD_RES (24)..(24): Any amino acid
  MOD_RES (26)..(27): Any amino acid
  MOD_RES (29)..(29): Ser, Gly or Thr
  MOD_RES (30)..(30): Any aromatic/hydrophobic amino acid
  MOD_RES (31)..(31): Any amino acid
  MOD_RES (33)..(33): Any amino acid
  MOD_RES (34)..(36): Any amino acid; this region may encompass 0-3 residues
  MOD_RES (37)..(37): Any amino acid
  MOD_RES (39)..(40): Any amino acid
  MOD_RES (41)..(41): Gly, Ser or Asn
  MOD_RES (42)..(42): Any aromatic/hydrophobic amino acid or Ser
  MOD_RES (43)..(48): Any amino acid
  MOD_RES (49)..(53): Any amino acid; this region may encompass 0-5 residues
  MOD_RES (54)..(56): Any amino acid
DXXECXXXXXXXXCXDXXXXXXCXNXXGXXXCXXXXXCXXXXXXXXXXXXXXXXXXC

SEQ ID NO: 65 - protein, 34 aa, Artificial Sequence
  Description of Artificial Sequence: Synthetic polypeptide
  MOD_RES (2)..(3): Any amino acid
  MOD_RES (4)..(4): Any amino acid
  misc_feature (4)..(5): This region may encompass 0-2 residues
  MOD_RES (5)..(5): Any hydrophobic or aromatic/hydrophobic amino acid
  MOD_RES (6)..(8): Any amino acid
  MOD_RES (10)..(10): Any amino acid
  MOD_RES (11)..(11): Any negatively charged amino acid or Ser
  MOD_RES (12)..(14): Any amino acid
  MOD_RES (15)..(15): Any negatively charged amino acid
  MOD_RES (16)..(16): Gly or Lys
  MOD_RES (17)..(17): Any amino acid
  MOD_RES (19)..(19): Asn or Asp
  MOD_RES (20)..(20): Any amino acid
  MOD_RES (21)..(21): Any negatively charged amino acid, Ser or Ala
  MOD_RES (23)..(23): Any negatively charged amino acid or Ser
  MOD_RES (24)..(25): Any amino acid
  MOD_RES (26)..(26): Ala, Glu or Gly
  MOD_RES (28)..(28): Any amino acid
  MOD_RES (29)..(29): Any aromatic/hydrophobic amino acid
  MOD_RES (32)..(32): Any amino acid
CXXXXXXXCXXXXXXXXCXXXCXXXXCXXDGXDC

SEQ ID NO: 66 - protein, 43 aa, Artificial Sequence
  Description of Artificial Sequence: Synthetic polypeptide
  MOD_RES (2)..(4): Any amino acid
  MOD_RES (5)..(5): Any aromatic/hydrophobic amino acid
  MOD_RES (6)..(6): Any aromatic/hydrophobic amino acid or His
  MOD_RES (7)..(7): Gly, Ser, Asn or Ala
  MOD_RES (8)..(9): Any amino acid
  MOD_RES (11)..(12): Any amino acid
  MOD_RES (13)..(13): Any aromatic/hydrophobic amino acid
  MOD_RES (15)..(15): Any amino acid
  MOD_RES (16)..(16): Pro, Ala or Glu
  MOD_RES (17)..(18): Any amino acid
  MOD_RES (19)..(19): Asp or Ala
  MOD_RES (20)..(21): Any amino acid
  MOD_RES (22)..(22): Any smaller, polar amino acid or Leu
  MOD_RES (23)..(23): His, Arg, Gly or Lys
  MOD_RES (24)..(24): Any aromatic/hydrophobic amino acid or Lys
  MOD_RES (25)..(25): Any amino acid
  MOD_RES (27)..(27): Asp, Asn, Ser or Gly
  MOD_RES (28)..(29): Any amino acid
  MOD_RES (31)..(33): Any amino acid
  MOD_RES (35)..(36): Any amino acid
  MOD_RES (38)..(38): Any aromatic/hydrophobic amino acid
  MOD_RES (39)..(39): Any amino acid
  MOD_RES (41)..(42): Any amino acid
CXXXXXXXXCXXXCXXXXXXXXXXXCXXXGXXXCXXGXXGXXC

SEQ ID NO: 67 - protein, 39 aa, Artificial Sequence
  Description of Artificial Sequence: Synthetic polypeptide
  MOD_RES (3)..(3): Any amino acid
  MOD_RES (4)..(4): Asp, His, Thr or Leu
  MOD_RES (5)..(5): Gly or Ala
  MOD_RES (6)..(9): Any amino acid
  MOD_RES (10)..(10): Pro, Leu, Ala, Asn or Thr
  MOD_RES (11)..(12): Any amino acid; this region may encompass 0-2 residues
  MOD_RES (13)..(16): Any amino acid
  MOD_RES (18)..(18): Glu, Ser, Gln, Asp, Ala or Thr
  MOD_RES (19)..(19): Any amino acid
  MOD_RES (20)..(20): Arg, Leu, Pro or Ser
  MOD_RES (21)..(26): Any amino acid
  MOD_RES (27)..(27): Gly, Glu, Pro or Ala
  misc_feature (27)..(28): This region may encompass 0-2 residues
  MOD_RES (28)..(28): Any amino acid
  MOD_RES (29)..(30): Any amino acid
  MOD_RES (32)..(33): Any amino acid
  MOD_RES (34)..(34): Ala, Val, Phe, Pro or Thr
  MOD_RES (35)..(35): Phe, Gln, Val or Tyr
  MOD_RES (36)..(37): Any amino acid
CCXXXXXXXXXXXXXXCXXXXXXXXXXXXXCXXXXXXCC

SEQ ID NO: 68 - protein, 41 aa, Artificial Sequence
  Description of Artificial Sequence: Synthetic polypeptide
  MOD_RES (2)..(3): Any amino acid
  MOD_RES (5)..(5): Val, Ile, Leu, Ala, Met or Phe
  MOD_RES (6)..(7): Any amino acid
  MOD_RES (8)..(8): Gly, His, Asp or Ser
  MOD_RES (9)..(9): Pro or Lys
  MOD_RES (10)..(10): Any amino acid
  MOD_RES (12)..(12): Gly, Ala, Ser or Thr
  MOD_RES (13)..(13): Trp, Tyr, Phe or Leu
  MOD_RES (15)..(18): Any amino acid
  MOD_RES (19)..(19): Trp, Tyr, Phe or Leu
  MOD_RES (20)..(22): Any amino acid
  MOD_RES (23)..(23): Gly or Arg
  misc_feature (23)..(25): This region may encompass 0-2 residues
  MOD_RES (24)..(25): Any amino acid
  MOD_RES (26)..(26): Any amino acid
  MOD_RES (27)..(27): Gly, Ala, Ser or Thr
  MOD_RES (28)..(28): Any amino acid
  MOD_RES (31)..(31): Asp, Asn, Ala or Glu
  MOD_RES (32)..(35): Any amino acid
  MOD_RES (37)..(37): Val, Ile, Leu, Ala, Met or Phe
  MOD_RES (38)..(39): Any amino acid
  MOD_RES (40)..(40): Gly or Asn
CXXCXXXXXXCXXCXXXXXXXXXXXXXXRCXXXXXLXXXXC

SEQ ID NO: 69 - protein, 57 aa, Artificial Sequence; identical to SEQ ID NO: 64
  Description of Artificial Sequence: Synthetic polypeptide
  MOD_RES (2)..(2): Val, Ile, Leu or Phe
  MOD_RES (3)..(3): Asp or Asn
  MOD_RES (6)..(7): Any amino acid
  MOD_RES (8)..(9): Any amino acid; this region may encompass 0-2 residues
  MOD_RES (10)..(13): Any amino acid
  MOD_RES (15)..(15): Pro, Asp or Gly
  misc_feature (16)..(17): This region may encompass 0-2 residues
  MOD_RES (17)..(17): Any amino acid
  MOD_RES (18)..(22): Any amino acid
  MOD_RES (24)..(24): Any amino acid
  MOD_RES (26)..(27): Any amino acid
  MOD_RES (29)..(29): Ser, Gly or Thr
  MOD_RES (30)..(30): Phe or Tyr
  MOD_RES (31)..(31): Any amino acid
  MOD_RES (33)..(33): Any amino acid
  MOD_RES (34)..(36): Any amino acid; this region may encompass 0-3 residues
  MOD_RES (37)..(37): Any amino acid
  MOD_RES (39)..(40): Any amino acid
  MOD_RES (41)..(41): Gly, Ser or Asn
  MOD_RES (42)..(42): Any aromatic/hydrophobic amino acid or Ser
  MOD_RES (43)..(48): Any amino acid
  MOD_RES (49)..(53): Any amino acid; this region may encompass 0-5 residues
  MOD_RES (54)..(56): Any amino acid

SEQ ID NO: 70 - protein, 34 aa, Artificial Sequence; identical to SEQ ID NO: 65
  Description of Artificial Sequence: Synthetic polypeptide
  MOD_RES (2)..(3): Any amino acid
  MOD_RES (4)..(4): Any amino acid
  misc_feature (4)..(5): This region may encompass 0-2 residues
  MOD_RES (5)..(5): Tyr, Ile, Phe, Leu or Val
  MOD_RES (6)..(8): Any amino acid
  MOD_RES (10)..(10): Any amino acid
  MOD_RES (11)..(11): Asp, Glu, Asn or Ser
  MOD_RES (12)..(14): Any amino acid
  MOD_RES (15)..(15): Asn, Asp or Glu
  MOD_RES (16)..(16): Gly or Lys
  MOD_RES (17)..(17): Any amino acid
  MOD_RES (19)..(19): Asn or Asp
  MOD_RES (20)..(20): Any amino acid
  MOD_RES (21)..(21): Asp, Glu, Asn, Ser or Ala
  MOD_RES (23)..(23): Asn, Ser, Asp or Glu
  MOD_RES (24)..(25): Any amino acid
  MOD_RES (26)..(26): Ala, Glu or Gly
  MOD_RES (28)..(28): Any amino acid
  MOD_RES (29)..(29): Trp, Tyr or Phe
  MOD_RES (32)..(32): Any amino acid

SEQ ID NO: 71 - protein, 43 aa, Artificial Sequence; identical to SEQ ID NO: 66
  Description of Artificial Sequence: Synthetic polypeptide
  MOD_RES (2)..(4): Any amino acid
  MOD_RES (5)..(5): Tyr, Trp or Phe
  MOD_RES (6)..(6): Tyr, Phe or His
  MOD_RES (7)..(7): Gly, Ala, Ser or Asn
  MOD_RES (8)..(9): Any amino acid
  MOD_RES (11)..(12): Any amino acid
  MOD_RES (13)..(13): Phe or Tyr
  MOD_RES (15)..(15): Any amino acid
  MOD_RES (16)..(16): Pro, Ala or Glu
  MOD_RES (17)..(18): Any amino acid
  MOD_RES (19)..(19): Asp or Ala
  MOD_RES (20)..(21): Any amino acid
  MOD_RES (22)..(22): Gly, Leu, Ala, Ser or Thr
  MOD_RES (23)..(23): His, Arg, Gly or Lys
  MOD_RES (24)..(24): Tyr, Lys, Phe or Trp
  MOD_RES (25)..(25): Any amino acid
  MOD_RES (27)..(27): Asp, Ser, Gly or Asn
  MOD_RES (28)..(29): Any amino acid
  MOD_RES (31)..(33): Any amino acid
  MOD_RES (35)..(36): Any amino acid
  MOD_RES (38)..(38): Trp, Leu, Phe or Tyr
  MOD_RES (39)..(39): Any amino acid
  MOD_RES (41)..(42): Any amino acid

SEQ ID NO: 72 - protein, 38 aa, Artificial Sequence
  Description of Artificial Sequence: Synthetic polypeptide
  MOD_RES (3)..(3): Any amino acid
  MOD_RES (4)..(4): Ala, Asp, Glu, His, Leu or Thr
  MOD_RES (6)..(13): Any amino acid
  MOD_RES (14)..(14): Any amino acid; this region may encompass 0-1 residues
  MOD_RES (15)..(15): Asp, Glu, Arg, Ser or Thr
  MOD_RES (17)..(25): Any amino acid
  MOD_RES (26)..(27): Any amino acid
  misc_feature (26)..(28): This region may encompass 0-3 residues
  MOD_RES (28)..(28): Ala, Glu, Arg, Ser or Val
  MOD_RES (30)..(31): Any amino acid
  MOD_RES (32)..(32): Ala, Pro, Val or Thr
  MOD_RES (33)..(33): Phe, Met or Gln
  MOD_RES (34)..(34): Glu, Lys, Leu, Gln, Arg, Thr or Val
  MOD_RES (35)..(35): Ala, Asp, Glu, His, Gln, Arg, Ser or Lys
  MOD_RES (36)..(36): Any amino acid; this region may encompass 0-1 residues
CCXXGXXXXXXXXXXCXXXXXXXXXXXXCXXXXXXXCC

SEQ ID NO: 73 - protein, 41 aa, Artificial Sequence; identical to SEQ ID NO: 68
  Description of Artificial Sequence: Synthetic polypeptide
  MOD_RES (2)..(2): Ala, Glu, Gly, Lys, Gln, Arg, Ser or Thr
  MOD_RES (3)..(3): Lys, Arg, Glu, Gln or Asp
  MOD_RES (5)..(5): Ile or Leu
  MOD_RES (6)..(6): Ala, Glu, Leu, Gln, Arg or Val
  MOD_RES (7)..(7): Val, Ile, Leu, Ala or Ser
  MOD_RES (8)..(8): Asp, Gly, His or Ser
  MOD_RES (9)..(9): Lys or Pro
  MOD_RES (10)..(10): Any amino acid
  MOD_RES (12)..(12): Gly, Ala, Ser or Thr
  MOD_RES (13)..(13): Trp or Tyr
  MOD_RES (15)..(18): Any amino acid
  MOD_RES (19)..(19): Phe or Leu
  MOD_RES (20)..(23): Any amino acid
  MOD_RES (24)..(27): Any amino acid
  misc_feature (24)..(29): This region may encompass 0-6 residues
  MOD_RES (28)..(28): Val, Ile, Leu, Ala or Arg
  MOD_RES (31)..(31): Ala, Asn or Asp
  MOD_RES (32)..(32): Asp, Ile, Leu, Arg or Thr
  MOD_RES (33)..(33): Ile, Lys, Leu, Pro, Gln, Arg or Val
  MOD_RES (34)..(34): Ala, Asp, Glu, Pro or Ser
  MOD_RES (35)..(35): Ala, Glu, Asn or Gln
  MOD_RES (37)..(37): Ile, Lys, Leu, Gln or Val
  MOD_RES (38)..(38): Any amino acid
  MOD_RES (39)..(39): Ala, Asp, Lys, Asn or Arg
  MOD_RES (40)..(40): Gly or Asn

SEQ ID NO: 74 - protein, 38 aa, Artificial Sequence
  Description of Artificial Sequence: Synthetic consensus polypeptide
  MOD_RES (2)..(2): Ala, Gly, Leu, Gln, Arg or Val
  MOD_RES (3)..(3): Ala, Leu, Pro, Ser or Thr
  MOD_RES (4)..(4): Asp, Gly, Ile, Asn, Arg or Ser
  MOD_RES (5)..(5): Glu, Leu or Gln
  MOD_RES (7)..(7): Pro, Gln or Thr
  MOD_RES (9)..(9): Gly, His, Lys, Asn, Gln, Arg or Ser
  MOD_RES (10)..(10): Asp, Gly, Asn or Ser
  MOD_RES (11)..(11): Gly, Ser or Thr
  MOD_RES (12)..(12): Glu, Gly, Lys, Asn, Arg or Ser
  MOD_RES (13)..(13): Ile, Arg, Ser, Thr or not present
  MOD_RES (15)..(15): Ile, Leu or Val
  MOD_RES (16)..(16): Pro or Ser
  MOD_RES (17)..(17): Leu, Pro, Gln, Arg or Val
  MOD_RES (18)..(18): Ala, His, Lys, Pro, Gln, Arg or Thr
  MOD_RES (20)..(20): Leu, Arg or Val
  MOD_RES (24)..(24): Asp, Glu or Val
  MOD_RES (25)..(25): Asp, Asn or Pro
  MOD_RES (28)..(28): Glu, Gly or Arg
  MOD_RES (30)..(30): Asp, Gly, Asn or Ser
  MOD_RES (34)..(34): Ala, Glu, Lys, Ser or Thr
  MOD_RES (35)..(35): Asp, Gly, Asn, Pro or Ser
  MOD_RES (36)..(36): Ala, Asp or not present
  MOD_RES (37)..(37): Ile, His or not present
CXXXXFXCXXXXXCXXXXWXCDGXXDCXDXSDEXXXXC

SEQ ID NO: 75 - protein, 35 aa, Artificial Sequence
  Description of Artificial Sequence: Synthetic polypeptide
CASGQFQCSNGNCVPQHWVCDGDNDCEDNSDEEDC

SEQ ID NO: 76 - protein, 38 aa, Artificial Sequence
  Description of Artificial Sequence: Synthetic polypeptide
CASGQFTCRSTNICLSLAWLCDGDDDCEDNSDESPAIC

SEQ ID NO: 77 - protein, 36 aa, Artificial Sequence
  Description of Artificial Sequence: Synthetic polypeptide
CGAGLFTCRSTKICISQAWVCDGVDDCEDNSDEKNC

SEQ ID NO: 78 - protein, 36 aa, Artificial Sequence
  Description of Artificial Sequence: Synthetic polypeptide
CRSRQFQCKGSSTCIPVQWVCDGDNDCGDSSDEAGC

SEQ ID NO: 79 - protein, 36 aa, Artificial Sequence
  Description of Artificial Sequence: Synthetic polypeptide
CGAGQFQCRSTNICISLKWVCDGVDDCEDNSDETSC

SEQ ID NO: 80 - protein, 36 aa, Artificial Sequence
  Description of Artificial Sequence: Synthetic polypeptide
CGAGQFQCRSTNICVSLAWRCDGEDDCEDNSDETSC

SEQ ID NO: 81 - protein, 36 aa, Artificial Sequence
  Description of Artificial Sequence: Synthetic polypeptide
CGAGQFTCNSTNICISPRWVCDGVNDCEDNSDEKNC

SEQ ID NO: 82 - protein, 36 aa, Artificial Sequence
  Description of Artificial Sequence: Synthetic polypeptide
CGAGQFTCRDTNICISRAWRCDGVDDCEDNSDEADC

SEQ ID NO: 83 - protein, 36 aa, Artificial Sequence
  Description of Artificial Sequence: Synthetic polypeptide
CGAGQFTCRSTKICISQAWVCDGVDDCEDNSDEAGC

SEQ ID NO: 84 - protein, 36 aa, Artificial Sequence
  Description of Artificial Sequence: Synthetic polypeptide
CGAGQFTCRSTKICISQAWVCDGVDDCEDNSDEKNC

SEQ ID NO: 85 - protein, 36 aa, Artificial Sequence
  Description of Artificial Sequence: Synthetic polypeptide
CGAGQFTCRSTKICISQAWVCDGVDDCEDNSDETSC

SEQ ID NO: 86 - protein, 36 aa, Artificial Sequence
  Description of Artificial Sequence: Synthetic polypeptide
CGAGQFTCRSTNICLPLQWVCDGVDDCEDNSDEAGC

SEQ ID NO: 87 - protein, 38 aa, Artificial Sequence
  Description of Artificial Sequence: Synthetic polypeptide
CGANQFTCHNTNICISLTWVCDGVDDCEDGSDESPDHC

SEQ ID NO: 88 - protein, 36 aa, Artificial Sequence
  Description of Artificial Sequence: Synthetic polypeptide
CGANQFTCHNTNICISLTWVCDGVDDCEDNSDEAGC

SEQ ID NO: 89 - protein, 36 aa, Artificial Sequence
  Description of Artificial Sequence: Synthetic polypeptide
CGANQFTCHNTNICISQAWVCDGVDDCEDNSDEKNC

SEQ ID NO: 90 - protein, 36 aa, Artificial Sequence
  Description of Artificial Sequence: Synthetic polypeptide
CGARQFPCRGSRICISQPWVCDGDNDCEDNSDEKNC

SEQ ID NO: 91 - protein, 36 aa, Artificial Sequence
  Description of Artificial Sequence: Synthetic polypeptide
CGPGQFTCQDTEICISQAWVCDGVDDCEDNSDEKNC

SEQ ID NO: 92 - protein, 36 aa, Artificial Sequence
  Description of Artificial Sequence: Synthetic polypeptide
CGPIQFTCRNTNICLSVHWVCDGEDDCEDGSDEEGC

SEQ ID NO: 93 - protein, 36 aa, Artificial Sequence
  Description of Artificial Sequence: Synthetic polypeptide
CGPNQFTCRSTNICLSQTWVCDGVDDCEDGSDETNC

SEQ ID NO: 94 - protein, 36 aa, Artificial Sequence
  Description of Artificial Sequence: Synthetic polypeptide
CGPSQFTCRNTNICISLRWRCDGVDDCEDNSDEEGC

SEQ ID NO: 95 - protein, 36 aa, Artificial Sequence
  Description of Artificial Sequence: Synthetic polypeptide
CGSNQFTCRSTNICISQAWVCDGVDDCEDDSDETGC

SEQ ID NO: 96 - protein, 36 aa, Artificial Sequence
  Description of Artificial Sequence: Synthetic polypeptide
CGSSEFQCRNSRRCIPPAWVCDGDNDCGDSSDEKSC

SEQ ID NO: 97 - protein, 36 aa, Artificial Sequence
  Description of Artificial Sequence: Synthetic polypeptide
CGSSQFTCHNTNICLPQAWVCDGVDDCEDNSDEKNC

SEQ ID NO: 98 - protein, 36 aa, Artificial Sequence
  Description of Artificial Sequence: Synthetic polypeptide
CGSSQFTCHNTNICLPRARVCDGVDDCEDNSDEAGC

SEQ ID NO: 99 - protein, 36 aa, Artificial Sequence
  Description of Artificial Sequence: Synthetic polypeptide
CGSSQFTCHNTNICLPRAWVCDGVDDCEDNSDEAGC

SEQ ID NO: 100 - protein, 36 aa, Artificial Sequence
  Description of Artificial Sequence: Synthetic polypeptide
CGSSQFTCHNTNICLPRAWVCDGVDDCEDNSDEKNC

SEQ ID NO: 101 - protein, 36 aa, Artificial Sequence
  Description of Artificial Sequence: Synthetic polypeptide
CGTGQFTCRSTKICISQAWVCDGVDDCEDNSDEKNC

SEQ ID NO: 102 - protein, 36 aa, Artificial Sequence
  Description of Artificial Sequence: Synthetic polypeptide
CLSDQFTCRSTNICLPLQWVCDGDDDCEDNSDEEDC

SEQ ID NO: 103 - protein, 36 aa, Artificial Sequence
  Description of Artificial Sequence: Synthetic polypeptide
CQSNEFQCRSTGRCISVAWVCDGEDDCRDSSDEADC

SEQ ID NO: 104 - protein, 35 aa, Artificial Sequence
  Description of Artificial Sequence: Synthetic polypeptide
CRLNEFPCGSGSCISLHWVCDSVPDCRDDSDETDC

SEQ ID NO: 105 - protein, 37 aa, Artificial Sequence
  Description of Artificial Sequence: Synthetic polypeptide
CVPGQFQCNNGNCIPVTWLCDGDNDCGDSSDEAPAHC

SEQ ID NO: 106 - protein, 35 aa, Artificial Sequence
  Description of Artificial Sequence: Synthetic polypeptide
CVSGQFQCGNGNCIPQAWLCDGDNDCGDSSDEKDC

SEQ ID NO: 107 - protein, 35 aa, Artificial Sequence
  Description of Artificial Sequence: Synthetic polypeptide
CVSGQFQCGNGNCIPRPWRCDGDNDCGDSSDETGC

SEQ ID NO: 108 - protein, 36 aa, Artificial Sequence
  Description of Artificial Sequence: Synthetic consensus polypeptide
  MOD_RES (3)..(3): Ala or Glu
  MOD_RES (4)..(4): Gly or Ser
  MOD_RES (9)..(9): Gly or Arg
  MOD_RES (10)..(10): Asn, Arg or Ser
  MOD_RES (11)..(11): Ala, Ser or Thr
  MOD_RES (12)..(12): Lys or Asn
  MOD_RES (17)..(17): Glu, His, Gln or Ser
  MOD_RES (18)..(18): Ala or Val
  MOD_RES (20)..(20): Ile or Val
  MOD_RES (24)..(24): Ile or Val
  MOD_RES (28)..(28): Asp or Glu
  MOD_RES (34)..(34): Asp, Lys, Met, Asn or Thr
  MOD_RES (35)..(35): Asn, Ser or Tyr
CGXXLFTCXXXXICISXXWXCDGXDDCXDNSDEXXC

SEQ ID NO: 109 - protein, 36 aa, Artificial Sequence
  Description of Artificial Sequence: Synthetic polypeptide
CGAGLFTCRSTNICISQVWVCDGVDDCEDNSDEDSC

SEQ ID NO: 110 - protein, 36 aa, Artificial Sequence
  Description of Artificial Sequence: Synthetic polypeptide
CGAGLFTCRSTNICISQAWVCDGVDDCEDNSDENYC

SEQ ID NO: 111 - protein, 36 aa, Artificial Sequence
  Description of Artificial Sequence: Synthetic polypeptide
CGAGLFTCRSTNICISQAWVCDGVDDCEDNSDETNC

SEQ ID NO: 112 - protein, 36 aa, Artificial Sequence
  Description of Artificial Sequence: Synthetic polypeptide
CGEGLFTCGSTNICISSAWVCDGVDDCEDNSDENNC

SEQ ID NO: 113 - protein, 36 aa, Artificial Sequence
  Description of Artificial Sequence: Synthetic polypeptide
CGEGLFTCRSTNICISHAWVCDGVDDCEDNSDENNC

SEQ ID NO: 114 - protein, 36 aa, Artificial Sequence
  Description of Artificial Sequence: Synthetic polypeptide
CGEGLFTCRSTNICISEAWICDGVDDCEDNSDEKNC

SEQ ID NO: 115 - protein, 36 aa, Artificial Sequence
  Description of Artificial Sequence: Synthetic polypeptide
CGAGLFTCRSAKICISHAWVCDGIDDCEDNSDENNC

SEQ ID NO: 116 - protein, 36 aa, Artificial Sequence
  Description of Artificial Sequence: Synthetic polypeptide
CGAGLFTCRNSKICISQAWVCDGVDDCDDNSDEKYC

SEQ ID NO: 117 - protein, 36 aa, Artificial Sequence
  Description of Artificial Sequence: Synthetic polypeptide
CGASLFTCRRSNICISQAWVCDGVDDCEDNSDEMNC

SEQ ID NO: 118 - protein, 36 aa, Artificial Sequence; identical to SEQ ID NO: 77
  Description of Artificial Sequence: Synthetic polypeptide

SEQ ID NO: 119 - protein, 36 aa, Artificial Sequence
  Description of Artificial Sequence: Synthetic consensus polypeptide
  MOD_RES (3)..(3): Ala, Pro, Ser or Thr
  MOD_RES (4)..(4): Asp or Asn
  MOD_RES (5)..(5): Leu, Met, Gln
  MOD_RES (9)..(9): Gln or Arg
  MOD_RES (10)..(10): Arg or Ser
  MOD_RES (13)..(13): Ile or Met
  MOD_RES (17)..(17): Asp, Lys, Pro, Gln or Arg
  MOD_RES (18)..(18): Ala, Thr or Val
  MOD_RES (28)..(28): Asp or Glu
  MOD_RES (30)..(30): Asp, Glu, Asn or Tyr
  MOD_RES (34)..(34): Ile, Gln, Arg or Thr
  MOD_RES (35)..(35): Ala, Gly, Thr or Val
CGXXXFTCXXTNXCISXXWVCDGVDDCXDXSDEXXC

SEQ ID NO: 120 - protein, 36 aa, Artificial Sequence
  Description of Artificial Sequence: Synthetic polypeptide
CGANLFTCQSTNICISDAWVCDGVDDCEDNSDETTC

SEQ ID NO: 121 - protein, 36 aa, Artificial Sequence
  Description of Artificial Sequence: Synthetic polypeptide
CGTNMFTCQRTNICISDAWVCDGVDDCEDYSDETAC

SEQ ID NO: 122 - protein, 36 aa, Artificial Sequence
  Description of Artificial Sequence: Synthetic polypeptide
CGTNLFTCRSTNMCISQAWVCDGVDDCEDNSDETVC

SEQ ID NO: 123 - protein, 36 aa, Artificial Sequence
  Description of Artificial Sequence: Synthetic polypeptide
CGSNLFTCRRTNICISKAWVCDGVDDCEDNSDETGC

SEQ ID NO: 124 - protein, 36 aa, Artificial Sequence
  Description of Artificial Sequence: Synthetic polypeptide
CGANLFTCRSTNICISPAWVCDGVDDCEDYSDEIGC

SEQ ID NO: 125 - protein, 36 aa, Artificial Sequence
  Description of Artificial Sequence: Synthetic polypeptide
CGANLFTCRSTNICISPTWVCDGVDDCDDNSDEIGC

SEQ ID NO: 126 - protein, 36 aa, Artificial Sequence
  Description of Artificial Sequence: Synthetic polypeptide
CGPNLFTCRSTNICISRAWVCDGVDDCDDESDEQGC

SEQ ID NO: 127 - protein, 36 aa, Artificial Sequence
  Description of Artificial Sequence: Synthetic polypeptide
CGSNLFTCRSTNICISPAWVCDGVDDCDDDSDETGC

SEQ ID NO: 128 - protein, 36 aa, Artificial Sequence
  Description of Artificial Sequence: Synthetic polypeptide
CGSDMFTCRSTNICISKVWVCDGVDDCEDDSDERGC

SEQ ID NO: 129 - protein, 36 aa, Artificial Sequence; identical to SEQ ID NO: 95
  Description of Artificial Sequence: Synthetic polypeptide

SEQ ID NO: 130 - protein, 39 aa, Artificial Sequence
  Description of Artificial Sequence: Synthetic consensus polypeptide
  MOD_RES (2)..(2): Leu, Ala, Pro, Arg, Val, Lys, Gln, Gly, His or Ser
  MOD_RES (3)..(3): Ala, Pro, Ser, His or Arg
  MOD_RES (4)..(4): Not present or Thr
  MOD_RES (5)..(5): Asp, Asn, Gly, Ser, His, Ala or Phe
  MOD_RES (6)..(6): Glu, His or Gln
  MOD_RES (8)..(8): His, Pro, Gln, Thr, Arg or Trp
  MOD_RES (10)..(10): Gly, Ser, Gln, Arg, Asn, Leu, His or Lys
  MOD_RES (11)..(11): Ser, Asn or Asp
  MOD_RES (12)..(12): Gly, Ser, Thr, Asn or Tyr
  MOD_RES (13)..(13): Arg, His, Gln, Gly, His, Asn, Ser or Glu
  MOD_RES (14)..(14): Arg, Ile, Thr or not present
  MOD_RES (16)..(16): Ile, Leu or Val
  MOD_RES (17)..(17): His, Asn, Pro or Ser
  MOD_RES (18)..(18): Ala, Gly, His, Leu, Ser, Gln, Pro, Arg, Glu or Val
  MOD_RES (19)..(19): Thr, Pro, Gly, Ser, Arg, Ala, His, Asn or not present
  MOD_RES (20)..(20): Trp or Leu
  MOD_RES (21)..(21): Ile, Leu, Arg or Val
  MOD_RES (24)..(24): Gly, Met or Trp
  MOD_RES (25)..(25): Gly, Tyr, Asp, Val, Glu or Leu
  MOD_RES (26)..(26): Pro, Trp, Leu, Asp or Asn
  MOD_RES (29)..(29): Gly, Glu, Arg, Gln, Leu or Lys
  MOD_RES (31)..(31): Gly, Asn, Asp, Ser, Lys, Trp, His or Tyr
  MOD_RES (32)..(32): Pro, Gln, Ser or Trp
  MOD_RES (34)..(34): Glu, Pro, Gln or Tyr
  MOD_RES (35)..(35): Ala, Pro, Ser or not present
  MOD_RES (36)..(36): Leu, Pro, Gln, Ser or not present
  MOD_RES (37)..(37): Ala, Glu, His, Lys, Leu, Thr or Val
  MOD_RES (38)..(38): His, Ile, Leu, Ser, Thr, Asp, Asn, Gly, Met, Val or Trp
CXXXXXFXCXXXXXCXXXXXXCDXXXDCXDXXDXXXXXC

SEQ ID NO: 131 - protein, 37 aa, Artificial Sequence
  Description of Artificial Sequence: Synthetic polypeptide
CLPDEFQCGSGRCIPQTWVCDGLNDCGDGSDESPAHC

SEQ ID NO: 132 - protein, 35 aa, Artificial Sequence
  Description of Artificial Sequence: Synthetic polypeptide
CAANEFTCRSGRCLSRPWLCDGENDCGDGSDEADC

SEQ ID NO: 133 - protein, 36 aa, Artificial Sequence; identical to SEQ ID NO: 95
  Description of Artificial Sequence: Synthetic polypeptide

SEQ ID NO: 134 - protein, 38 aa, Artificial Sequence
  Description of Artificial Sequence: Synthetic polypeptide
CPSNQFPCRSTGICIPLAWVCDGLNDCGDGSDESPATC

SEQ ID NO: 135 - protein, 38 aa, Artificial Sequence; identical to SEQ ID NO: 134
  Description of Artificial Sequence: Synthetic polypeptide

SEQ ID NO: 136 - protein, 36 aa, Artificial Sequence
  Description of Artificial Sequence: Synthetic polypeptide
CAANEFRCSNGRCIPEPWLCDGLNDCGDGSDEPPHC

SEQ ID NO: 137 - protein, 36 aa, Artificial Sequence
  Description of Artificial Sequence: Synthetic polypeptide
CPSNEFQCQNSGRCIPRRWLCDGEDDCGDNSDEASC

SEQ ID NO: 138 - protein, 35 aa, Artificial Sequence
  Description of Artificial Sequence: Synthetic polypeptide
CQSSEFQCSNGSCIPRPLVCDGENDCGDSSDETDC

SEQ ID NO: 139 - protein, 37 aa, Artificial Sequence
  Description of Artificial Sequence: Synthetic polypeptide
CRPGEFRCRSTNTCISQSLRCDGEPDCRDGSDEPEDC

SEQ ID NO: 140 - protein, 36 aa, Artificial Sequence
  Description of Artificial Sequence: Synthetic polypeptide
CRSSEFPCHGYSTCISLSLLCDGVDDCADNSDEESC

SEQ ID NO: 141 - protein, 34 aa, Artificial Sequence
  Description of Artificial Sequence: Synthetic polypeptide
CHHHHFHCLSGECINTWRCDGGPDCKDKSDEENC

SEQ ID NO: 142 - protein, 35 aa, Artificial Sequence
  Description of Artificial Sequence: Synthetic polypeptide
CSRAHFHCLSGECIHHHWRCDGGPDCKDKSDEENC

SEQ ID NO: 143 - protein, 35 aa, Artificial Sequence
  Description of Artificial Sequence: Synthetic polypeptide
CSAFEFHCLSGECIHSSWRCDMDWDCKDQPDQLWC

SEQ ID NO: 144 - protein, 35 aa, Artificial Sequence
  Description of Artificial Sequence: Synthetic polypeptide
CSAFEFHCLSGECIHSSWRCDWYWDCKDYWDPLVC

SEQ ID NO: 145 - protein, 35 aa, Artificial Sequence
  Description of Artificial Sequence: Synthetic polypeptide
CSAFEFHCLSGECIHSSWRCDWDDDCKDWQDYVMC

SEQ ID NO: 146 - protein, 35 aa, Artificial Sequence
  Description of Artificial Sequence: Synthetic polypeptide
CSAFEFHCLSGECIHSSWRCDWDLDCKDHPDEVMC

SEQ ID NO: 147 - protein, 35 aa, Artificial Sequence
  Description of Artificial Sequence: Synthetic polypeptide
CVPNQFPRGNGSCIPLPLVCDGVDDCLDDSDEKNC

SEQ ID NO: 148 - protein, 35 aa, Artificial Sequence
  Description of Artificial Sequence: Synthetic polypeptide
CVPNQFQCGSGRCLPHPLGCDGVDDCLDGSDEASC

SEQ ID NO: 149 - protein, 36 aa, Artificial Sequence
  Description of Artificial Sequence: Synthetic polypeptide
CVSDEFPCRDNNICVLLHLLCDGVDDCLDSSDETGC

SEQ ID NO: 150 - protein, 37 aa, Artificial Sequence
  Description of Artificial Sequence: Synthetic polypeptide
CAPSQFQCHDNNICLLEGLLCDGEDDCADGSDEAPVC

SEQ ID NO: 151 - protein, 36 aa, Artificial Sequence
  Description of Artificial Sequence: Synthetic polypeptide
CRSSQFPCQDSNICVLETLLCDGVDDCVDDSDEEDC

SEQ ID NO: 152 - protein, 35 aa, Artificial Sequence
  Description of Artificial Sequence: Synthetic polypeptide
CRSNQFRCNSGHCLPRPWLCDGVDDCQDDSDETDC

SEQ ID NO: 153 - protein, 37 aa, Artificial Sequence
  Description of Artificial Sequence: Synthetic polypeptide
CRPGQFWCNSGRCLPPAWRCDGVNDCGDDSDEPLALC

SEQ ID NO: 154 - protein, 37 aa, Artificial Sequence
  Description of Artificial Sequence: Synthetic polypeptide
CLPNQFRCGNGHCLSRTWVCDGVPDCEDNSDESLAHC

SEQ ID NO: 155 - protein, 37 aa, Artificial Sequence
  Description of Artificial Sequence: Synthetic polypeptide
CPAGQFQCGNGQCLSLTWLCDGVPDCGDNSDESSALC

SEQ ID NO: 156 - protein, 37 aa, Artificial Sequence
  Description of Artificial Sequence: Synthetic polypeptide
CPPSQFTCGNGRCVSLGWVCDGLNDCGDGSDESPALC

SEQ ID NO: 157 - protein, 37 aa, Artificial Sequence; identical to SEQ ID NO: 156
  Description of Artificial Sequence: Synthetic polypeptide

SEQ ID NO: 158 - protein, 37 aa, Artificial Sequence
  Description of Artificial Sequence: Synthetic polypeptide
CRPNEFPCNNGRCLSQTWVCDGLNDCGDGSDESPELC

SEQ ID NO: 159 - protein, 36 aa, Artificial Sequence
  Description of Artificial Sequence: Synthetic polypeptide
CQSNEFRCRSGRCIPQHWLCDGLNDCGDGSDESQQC

SEQ ID NO: 160 - protein, 37 aa, Artificial Sequence
  Description of Artificial Sequence: Synthetic polypeptide
CQPDEFTCSSGRCIPQPWLCDGLNDCGDGSDEPPAHC

SEQ ID NO: 161 - protein, 37 aa, Artificial Sequence
  Description of Artificial Sequence: Synthetic polypeptide
CQPDEFTCRSGRCIPQPWLCDGLNDCGDGSDEPPGHC

SEQ ID NO: 162 - protein, 37 aa, Artificial Sequence
  Description of Artificial Sequence: Synthetic polypeptide
CPPNQFRCGNGHCLSVSWLCDGVPDCGDNSDEALAIC

SEQ ID NO: 163 - protein, 37 aa, Artificial Sequence
  Description of Artificial Sequence: Synthetic polypeptide
CRANEFRCNSGRCLSQTWVCDGVDDCEDGSDESLAIC

SEQ ID NO: 164 - protein, 37 aa, Artificial Sequence
  Description of Artificial Sequence: Synthetic polypeptide
CRANQFTCNNGHCLSRTWLCDGVPDCEDNSDESLAIC

SEQ ID NO: 165 - protein, 37 aa, Artificial Sequence; identical to SEQ ID NO: 164
  Description of Artificial Sequence: Synthetic polypeptide

SEQ ID NO: 166 - protein, 37 aa, Artificial Sequence; identical to SEQ ID NO: 164
  Description of Artificial Sequence: Synthetic polypeptide

SEQ ID NO: 167 - protein, 37 aa, Artificial Sequence
  Description of Artificial Sequence: Synthetic polypeptide
CLPGQFRCNSGHCLSQTWVCDGYNDCGDGSDEPLATC

SEQ ID NO: 168 - protein, 36 aa, Artificial Sequence
  Description of Artificial Sequence: Synthetic polypeptide
CKPTNEFRCSNGHCISRALLCDGENDCEDNSDETSC

SEQ ID NO: 169 - protein, 36 aa, Artificial Sequence
  Description of Artificial Sequence: Synthetic polypeptide
CASSEFQCRSTRTCVPLGWVCDGDNDCPDNSDETDC

SEQ ID NO: 170 - protein, 36 aa, Artificial Sequence
  Description of Artificial Sequence: Synthetic polypeptide
CHSFNQFECRNGQCIPLHLVCDGVPDCGDNSDETDC

SEQ ID NO: 171 - protein, 36 aa, Artificial Sequence
  Description of Artificial Sequence: Synthetic polypeptide
CQATAQFQCDNGHCLSANWRCDGVDDCGDNSDEEDC

SEQ ID NO: 172 - protein, 36 aa, Artificial Sequence; identical to SEQ ID NO: 171
  Description of Artificial Sequence: Synthetic polypeptide

SEQ ID NO: 173 - protein, 38 aa, Artificial Sequence
  Description of Artificial Sequence: Synthetic polypeptide
CKSIAQFECSNGHCLSRTWLCDGVDDCGDNSDEALATC

SEQ ID NO: 174 - protein, 37 aa, Artificial Sequence
  Description of Artificial Sequence: Synthetic polypeptide
CRPSEFQCGNGSCLSATWLCDGVPDCGDGSDESPETC

SEQ ID NO: 175 - protein, 35 aa, Artificial Sequence
  Description of Artificial Sequence: Synthetic polypeptide
CRPNEFQCGNGHCLSANWLCDGVDDCGDDSDETSC

SEQ ID NO: 176 - protein, 37 aa, Artificial Sequence
  Description of Artificial Sequence: Synthetic polypeptide
CPSSQFQCKNGHCLSRTWLCDGVDDCQDGSDESPAIC

SEQ ID NO: 177 - protein, 37 aa, Artificial Sequence
  Description of Artificial Sequence: Synthetic polypeptide
CPSSQFQCKNGHCLSRTWLCDGVDDCQDGSDESPATC

SEQ ID NO: 178 - protein, 35 aa, Artificial Sequence
  Description of Artificial Sequence: Synthetic polypeptide
CRSSQFQCNNGHCLSPTWVCDGYDDCEDGSDEANC

SEQ ID NO: 179 - protein, 35 aa, Artificial Sequence
  Description of Artificial Sequence: Synthetic polypeptide
CRSSEFQCNNGHCLSATWVCDGYDDCEDGSDEANC

SEQ ID NO: 180 - protein, 35 aa, Artificial Sequence
  Description of Artificial Sequence: Synthetic polypeptide
CPANQFRCNNGHCLSRTWVCDGYDDCEDGSDEANC

SEQ ID NO: 181 - protein, 37 aa, Artificial Sequence
  Description of Artificial Sequence: Synthetic polypeptide
CPANQFRCNNGHCLSGTWLCDGVDDCGDNSDESSATC

SEQ ID NO: 182 - protein, 35 aa, Artificial Sequence
  Description of Artificial Sequence: Synthetic polypeptide
CRSSEFQCGNGHCLSRTWLCDGVNDCGDDSDEKNC

SEQ ID NO: 183 - protein, 35 aa, Artificial Sequence
  Description of Artificial Sequence: Synthetic polypeptide
CLSNQFQCDNGHCLSLTWRCDGYNDCGDSSDEENC

SEQ ID NO: 184 - protein, 35 aa, Artificial Sequence
  Description of Artificial Sequence: Synthetic polypeptide
CRSSEFKCKNGHCLSATWVCDGYVDCGDDSDEEDC

SEQ ID NO: 185 - protein, 37 aa, Artificial Sequence
  Description of Artificial Sequence: Synthetic consensus polypeptide
  MOD_RES (2)..(2): Leu, Met or Pro
  MOD_RES (3)..(3): Pro, Ser or Thr
  MOD_RES (4)..(4): Asp or His
  MOD_RES (7)..(7): Gln or Arg
  MOD_RES (9)..(9): Gly or Arg
  MOD_RES (12)..(12): Arg or Trp
  MOD_RES (16)..(16): Leu, Gln or Arg
  MOD_RES (17)..(17): Ala, Lys, Arg, Ser or Thr
  MOD_RES (19)..(19): Gly or Val
  MOD_RES (33)..(33): Ser or Trp
  MOD_RES (36)..(36): His, Leu or Gln
CXXXEFXCXSGXCIPXXWXCDGLNDCGDGSGEXPAXC

SEQ ID NO: 186 - protein, 37 aa, Artificial Sequence
  Description of Artificial Sequence: Synthetic polypeptide
CLPDEFQCGSGRCIPLTWVCDGLNDCGDGSDESPAHC

SEQ ID NO: 187 - protein, 37 aa, Artificial Sequence
  Description of Artificial Sequence: Synthetic polypeptide
CLPDEFQCRSGRCIPQTWVCDGLNDCGDGSDESPAQC

SEQ ID NO: 188 - protein, 37 aa, Artificial Sequence
  Description of Artificial Sequence: Synthetic polypeptide
CLPHEFQCGSGRCIPQTWVCDGLNDCGDGSDEWPAQC

SEQ ID NO: 189 - protein, 37 aa, Artificial Sequence
  Description of Artificial Sequence: Synthetic polypeptide
CLPHEFQCRSGRCIPQAWGCDGLNDCGDGSDESPAQC

SEQ ID NO: 190 - protein, 37 aa, Artificial Sequence
  Description of Artificial Sequence: Synthetic polypeptide
CLSDEFQCRSGRCIPQRWVCDGLNDCGDGSDEWPAQC

SEQ ID NO: 191 - protein, 37 aa, Artificial Sequence
  Description of Artificial Sequence: Synthetic polypeptide
CMPDEFQCRSGRCIPRSWVCDGLNDCGDGSDESPSHC

SEQ ID NO: 192 - protein, 37 aa, Artificial Sequence
  Description of Artificial Sequence: Synthetic polypeptide
CMTDEFRCRSGRCIPQTWVCDGLNDCGDGSDEWPAQC

SEQ ID NO: 193 - protein, 37 aa, Artificial Sequence
  Description of Artificial Sequence: Synthetic polypeptide
CPPDEFQCRSGWCIPQKWVCDGLNDCGDGSDESPALC

SEQ ID NO: 194 - protein, 35 aa, Artificial Sequence
  Description of Artificial Sequence: Synthetic consensus polypeptide
  MOD_RES (2)..(2): Leu, Arg or Trp
  MOD_RES (3)..(3): Pro, Ser or Thr
  MOD_RES (4)..(4): Gly or Ser
  MOD_RES (5)..(5): Ala, Glu, His, Gln or Ser
  MOD_RES (7)..(7): His or Gln
  MOD_RES (9)..(9): Asn or Ser
  MOD_RES (10)..(10): Asn or Thr
  MOD_RES (16)..(16): Ala, Pro, Gln, Arg or Ser
  MOD_RES (17)..(17): Ser or Thr
  MOD_RES (23)..(23): Phe or Tyr
  MOD_RES (24)..(24): Asp, Glu, Val or Tyr
  MOD_RES (27)..(27): Asp, Glu or Gly
  MOD_RES (29)..(29): Gly or Trp
  MOD_RES (33)..(33): Ala, Ser or Val
  MOD_RES (34)..(34): Lys or Asn
CXXXXFXCXXGHCLSXXWVCDGXXDCXDXSDEXXC

SEQ ID NO: 195 - protein, 35 aa, Artificial Sequence
  Description of Artificial Sequence: Synthetic polypeptide
CLPSQFQCNNGHCLSRTWVCDGYDDCGDWSDESNC

SEQ ID NO: 196 - protein, 35 aa, Artificial Sequence
  Description of Artificial Sequence: Synthetic polypeptide
CLSGQFQCSNGHCLSRTWVCDGYVDCEDGSDEAKC

SEQ ID NO: 197 - protein, 35 aa, Artificial Sequence
  Description of Artificial Sequence: Synthetic polypeptide
CLSSSFQCNNGHCLSRTWVCDGYYDCEDGSDEVNC

SEQ ID NO: 198 - protein, 35 aa, Artificial Sequence
  Description of Artificial Sequence: Synthetic polypeptide
CRSGQFQCNNGHCLSATWVCDGYDDCDDGSDEANC

SEQ ID NO: 199 - protein, 35 aa, Artificial Sequence
  Description of Artificial Sequence: Synthetic polypeptide
CRSGQFQCNNGHCLSQTWVCDGYDDCDDGSDEANC

SEQ ID NO: 200 - protein, 35 aa, Artificial Sequence
  Description of Artificial Sequence: Synthetic polypeptide
CRSGQFQCNNGHCLSRTWVCDGYDDCDDGSDEANC

SEQ ID NO: 201 - protein, 35 aa, Artificial Sequence
  Description of Artificial Sequence: Synthetic polypeptide
CRSGQFQCNNGHCLSSTWVCDGFDDCEDGSDEANC

SEQ ID NO: 202 - protein, 35 aa, Artificial Sequence
  Description of Artificial Sequence: Synthetic polypeptide
CRSSEFQCNNGHCLSATWVCDGYDDCEDGSDESNC

SEQ ID NO: 203 - protein, 35 aa, Artificial Sequence
  Description of Artificial Sequence: Synthetic polypeptide
CRSSEFQCNTGHCLSRTWVCDGYDDCGDGSDEANC

SEQ ID NO: 204 - protein, 35 aa, Artificial Sequence
  Description of Artificial Sequence: Synthetic polypeptide
CRTSHFHCNNGHRLSRTWVCDGYEDCEDGSDEANC

SEQ ID NO: 205 - protein, 35 aa, Artificial Sequence
  Description of Artificial Sequence: Synthetic polypeptide
CWSSAFQCNNGHCLSPSWVCDGYDDCGDGSDEANC

SEQ ID NO: 206 - protein, 35 aa, Artificial Sequence; identical to SEQ ID NO: 198
  Description of Artificial Sequence: Synthetic polypeptide

SEQ ID NO: 207 - protein, 37 aa, Artificial Sequence
  Description of Artificial Sequence: Synthetic consensus polypeptide
  MOD_RES (2)..(2): Glu or Gln
  MOD_RES (3)..(3): Pro or Ser
  MOD_RES (4)..(4): Asp or Glu
  MOD_RES (7)..(7): Met, Arg or Thr
  MOD_RES (9)..(9): Arg or Ser
  MOD_RES (16)..(16): Gln or Val
  MOD_RES (17)..(17): His, Ile, Ser or Thr
  MOD_RES (33)..(33): Pro or Arg
  MOD_RES (35)..(35): Ala or Glu
  MOD_RES (36)..(36): His or Gln
CXXXEFXCXSGRCIPXXWLCDGLNDCGDGSDEXPXXC

SEQ ID NO: 208 - protein, 37 aa, Artificial Sequence
  Description of Artificial Sequence: Synthetic polypeptide
CEPEEFRCRSGRCIPQTWLCDGLNDCGDGSDEPPAHC

SEQ ID NO: 209 - protein, 37 aa, Artificial Sequence
  Description of Artificial Sequence: Synthetic polypeptide
CQPDEFTCRSGRCIPQSWLCDGLNDCGDGSDEPPAHC

SEQ ID NO: 210 - protein, 37 aa, Artificial Sequence
  Description of Artificial Sequence: Synthetic polypeptide
CQPDEFTCSSGRCIPQIWLCDGLNDCGDGSDERPEHC

SEQ ID NO: 211 - protein, 37 aa, Artificial Sequence
  Description of Artificial Sequence: Synthetic polypeptide
CQSDEFMCSSGRCIPVHWLCDGLNDCGDGSDERPAQC

SEQ ID NO: 212 - protein, 36 aa, Artificial Sequence
  Description of Artificial Sequence: Synthetic consensus polypeptide
  MOD_RES (2)..(2): His, Asn or Pro
  MOD_RES (3)..(3): Ser, Thr or Trp
  MOD_RES (5)..(5): His or Asn
  MOD_RES (6)..(6): His, Lys or Gln
  MOD_RES (8)..(8): Glu or Lys
  MOD_RES (12)..(12): Gly or Arg
  MOD_RES (18)..(18): His or Tyr
  MOD_RES (28)..(28): Ala or Gly
  MOD_RES (30)..(30): Asp or Asn
  MOD_RES (35)..(35): Ala, Asp or Tyr
CXXFXXFXCRNXQCIPLXLVCDGVPDCXDXSDETXC

SEQ ID NO: 213 - protein, 36 aa, Artificial Sequence
  Description of Artificial Sequence: Synthetic polypeptide
CHSFNQFECRNRQCIPLYLVCDGVPDCADNSDETDC

SEQ ID NO: 214 - protein, 36 aa, Artificial Sequence
  Description of Artificial Sequence: Synthetic polypeptide
CHTFNKFECRNGQCIPLYLVCDGVPDCGDNSDETAC

SEQ ID NO: 215 - protein, 36 aa, Artificial Sequence
  Description of Artificial Sequence: Synthetic polypeptide
CNSFNQFECRNRQCIPLYLVCDGVPDCGDNSDETYC

SEQ ID NO: 216 - protein, 36 aa, Artificial Sequence
  Description of Artificial Sequence: Synthetic polypeptide
CPWFHHFKCRNGQRIPLHLVCDGVPDCGDDSDETDC

SEQ ID NO: 217 - protein, 38 aa, Artificial Sequence
  Description of Artificial Sequence: Synthetic consensus polypeptide
  MOD_RES (2)..(2): Glu, Leu, Pro, Gln or Arg
  MOD_RES (3)..(3): Ala, Pro or Ser
  MOD_RES (4)..(4): Asp, Gly, Ile or Asn
  MOD_RES (5)..(5): Glu, Gly or Gln
  MOD_RES (6)..(6): Phe or Gln
  MOD_RES (7)..(7): Phe, Lys, Pro, Gln, Arg or Thr
  MOD_RES (8)..(8): Not present or Glu
  MOD_RES (10)..(10): Gly, Asn, Arg or Ser
  MOD_RES (11)..(11): Asn or Ser
  MOD_RES (13)..(13): His, Asn, Gln or Arg
  MOD_RES (15)..(15): Ile or Val
  MOD_RES (17)..(17): Ala, Glu, Leu, Pro, Gln, Arg or Val
  MOD_RES (18)..(18): Ala, His, Pro, Gln, Arg or Thr
  MOD_RES (20)..(20): Leu, Arg or Val
  MOD_RES (24)..(24): Asp, Glu or Val
  MOD_RES (25)..(25): Asp, Asn or Pro
  MOD_RES (28)..(28): Gly, Leu or Gln
  MOD_RES (30)..(30): Asp, Gly, Asn or Ser
  MOD_RES (34)..(34): Ala, Glu, Lys or Thr
  MOD_RES (35)..(35): Asp, Gly, Leu, Asn or Ser
  MOD_RES (36)..(36): Not present or Ala
  MOD_RES (37)..(37): Not present or His
CXXXXXXXCXXGXCXPXXWXCDGXXDCXDXSDEXXXXC

SEQ ID NO: 218 - protein, 35 aa, Artificial Sequence
  Description of Artificial Sequence: Synthetic polypeptide
CRAGEFRCSNGRCVPLTWLCDGEDDCQDNSDEKNC

SEQ ID NO: 219 - protein, 35 aa, Artificial Sequence
  Description of Artificial Sequence: Synthetic polypeptide
CPSSEFRCNNGRCIPLHWVCDGDDDCQDNSDETDC

SEQ ID NO: 220 - protein, 35 aa, Artificial Sequence
  Description of Artificial Sequence: Synthetic polypeptide
CRPGEFRCNNGRCVPQTWVCDGEDDCGDNSDETDC

SEQ ID NO: 221 - protein, 35 aa, Artificial Sequence
  Description of Artificial Sequence: Synthetic polypeptide
CLSDQFRCGNGRCVPRAWLCDGDNDCQDGSDETNC

SEQ ID NO: 222 - protein, 35 aa, Artificial Sequence
  Description of Artificial Sequence: Synthetic polypeptide
CLPGQFPCGNGRCIPETWLCDGDDDCQDGSDEKGC

SEQ ID NO: 223 - protein, 35 aa, Artificial Sequence
  Description of Artificial Sequence: Synthetic polypeptide
CQPNEFQCGNGRCIPAQWLCDGEDDCQDNSDEEDC

SEQ ID NO: 224 - protein, 38 aa, Artificial Sequence
  Description of Artificial Sequence: Synthetic polypeptide
CESIGQFECGNGHCIPPTWLCDGVNDCQDSSDEALAHC

SEQ ID NO: 225 - protein, 35 aa, Artificial Sequence
  Description of Artificial Sequence: Synthetic polypeptide
CQSNEFRCRNGQCIPLTWLCDGDNDCLDSSDEESC

SEQ ID NO: 226 - protein, 35 aa, Artificial Sequence
  Description of Artificial Sequence: Synthetic polypeptide
CPSGEFTCGSGRCIPPTWVCDGEPDCLDGSDEKSC

SEQ ID NO: 227 - protein, 35 aa, Artificial Sequence
  Description of Artificial Sequence: Synthetic polypeptide
CLPDEFKCGSGRCIPLRWVCDGDDDCQDGSDETDC

SEQ ID NO: 228 - protein, 38 aa, Artificial Sequence; identical to SEQ ID NO: 134
  Description of Artificial Sequence: Synthetic polypeptide

SEQ ID NO: 229 - protein, 35 aa, Artificial Sequence
  Description of Artificial Sequence: Synthetic polypeptide
CRSDEFRCGNGRCIPLTWVCDGEDDCQDSSDETGC

SEQ ID NO: 230 - protein, 35 aa, Artificial Sequence
  Description of Artificial Sequence: Synthetic polypeptide
CRSNQFTCGNGNCIPQPWVCDGEDDCGDDSDEESC

SEQ ID NO: 231 - protein, 35 aa, Artificial Sequence
  Description of Artificial Sequence: Synthetic polypeptide
CPPGQFRCNNGRCIPVHWRCDGENDCQDDSDEKSC

SEQ ID NO: 232 - protein, 37 aa, Artificial Sequence
  Description of Artificial Sequence: Synthetic consensus polypeptide
  MOD_RES (2)..(2): Ala, Gly, Leu or Pro
  MOD_RES (5)..(5): Glu or Gln
  MOD_RES (7)..(7): Lys or Arg
  MOD_RES (9)..(9): Gly, Lys, Asn, Arg or Ser
  MOD_RES (12)..(12): Asn, Gln, Arg or Ser
  MOD_RES (14)..(14): Ile or Leu
  MOD_RES (16)..(16): Glu, Leu or Gln
  MOD_RES (17)..(17): Asp, His, Asn or Thr
  MOD_RES (19)..(19): Leu, Arg or Val
  MOD_RES (23)..(23): Asp, Leu or Val
  MOD_RES (24)..(24): Asp or Asn
  MOD_RES (27)..(27): Glu, Gly or Val
  MOD_RES (29)..(29): Gly or Ser
  MOD_RES (33)..(33): Ala, Glu or Thr
  MOD_RES (34)..(34): Asp, Gly, Asn or Pro
  MOD_RES (35)..(35): Not present or Asp
  MOD_RES (36)..(36): Not present or Leu
CXPDXFXCXSGXCXPXXWXCDGXXDCXDXSDEXXXXC

SEQ ID NO: 233 - protein, 35 aa, Artificial Sequence
  Description of Artificial Sequence: Synthetic polypeptide
CPPDQFRCRSGRCIPQHWLCDGLNDCGDGSDEANC

SEQ ID NO: 234 - protein, 35 aa, Artificial Sequence
  Description of Artificial Sequence: Synthetic polypeptide
CAPDQFRCSSGQCIPETWLCDGDDDCVDSSDEAGC

SEQ ID NO: 235 - protein, 37 aa, Artificial Sequence
  Description of Artificial Sequence: Synthetic polypeptide
CGPDEFRCNSGRCLPLDWRCDGVDDCEDGSDEAPDLC

SEQ ID NO: 236 - protein, 35 aa, Artificial Sequence
  Description of Artificial Sequence: Synthetic polypeptide
CGPDQFRCKSGNCLPLNWVCDGVDDCGDSSDEEGC

SEQ ID NO: 237 - protein, 35 aa, Artificial Sequence
  Description of Artificial Sequence: Synthetic polypeptide
CLPDEFRCGSGRCIPQTWVCDGLNDCGDGSDETGC

SEQ ID NO: 238 - protein, 35 aa, Artificial Sequence; identical to SEQ ID NO: 234
  Description of Artificial Sequence: Synthetic polypeptide

SEQ ID NO: 239 - protein, 35 aa, Artificial Sequence
  Description of Artificial Sequence: Synthetic polypeptide
CGPDQFKCNSGSCIPLTWVCDGDNDCGDDSDETDC

SEQ ID NO: 240 - protein, 36 aa, Artificial Sequence
  Description of Artificial Sequence: Synthetic consensus polypeptide
  MOD_RES (3)..(3): Pro or Ser
  MOD_RES (4)..(4): Asp, Asn or Ser
  MOD_RES (5)..(5): Glu or Gln
  MOD_RES (7)..(7): Gln or Arg
  MOD_RES (9)..(9): Gly or His
  MOD_RES (10)..(10): Asp or Asn
  MOD_RES (11)..(11): Gly, Asn or Thr
  MOD_RES (12)..(12): Gly, His or Asn
  MOD_RES (13)..(13): Not present, Ile or Thr
  MOD_RES (15)..(15): Ile or Leu
  MOD_RES (16)..(16): Leu, Pro or Ser
  MOD_RES (17)..(17): Glu or Arg
  MOD_RES (18)..(18): Ala, Gly or Thr
  MOD_RES (19)..(19): Trp or Leu
  MOD_RES (24)..(24): Asp, Glu or Val
  MOD_RES (25)..(25): Asp or Asn
  MOD_RES (28)..(28): Ala, Glu or Gly
  MOD_RES (34)..(34): Ala or Glu
  MOD_RES (35)..(35): Asp or Gly
CAXXXFXCXXXXXCXXXXXLCDGXXDCXDGSDEXXC

SEQ ID NO: 241 - protein, 35 aa, Artificial Sequence
  Description of Artificial Sequence: Synthetic polypeptide
CASNQFRCGNGHCLSRTWLCDGVNDCEDGSDEADC

SEQ ID NO: 242 - protein, 36 aa, Artificial Sequence
  Description of Artificial Sequence: Synthetic polypeptide
CAPDEFRCHNTGTCIPRAWLCDGDNDCGDGSDEEGC

SEQ ID NO: 243 - protein, 36 aa, Artificial Sequence
  Description of Artificial Sequence: Synthetic polypeptide
CAPSQFQCHDNNICLLEGLLCDGEDDCADGSDEADC

SEQ ID NO: 244 - protein, 35 aa, Artificial Sequence; identical to SEQ ID NO: 241
  Description of Artificial Sequence: Synthetic polypeptide

SEQ ID NO: 245 - protein, 37 aa, Artificial Sequence
  Description of Artificial Sequence: Synthetic consensus polypeptide
  MOD_RES (2)..(2): Ala or Pro
  MOD_RES (4)..(4): Asp or Gly
  MOD_RES (5)..(5): Glu or Gln
  MOD_RES (7)..(7): Arg or Thr
  MOD_RES (9)..(9): Lys, Asn or Arg
  MOD_RES (10)..(10): Asn or Ser
  MOD_RES (12)..(12): Gln or Arg
  MOD_RES (14)..(14): Ile or Val
  MOD_RES (16)..(16): Leu or Gln
  MOD_RES (17)..(17): Ala, His or Pro
  MOD_RES (19)..(19): Leu or Val
  MOD_RES (23)..(23): Asp or Glu
  MOD_RES (24)..(24): Asp or Asn
  MOD_RES (27)..(27): Gly or Gln
  MOD_RES (33)..(33): Glu, Ser or Thr
  MOD_RES (34)..(34): Asp, Asn, Pro
  MOD_RES (35)..(35): Not present or Ala
  MOD_RES (36)..(36): Not present or Thr
CXPXXFXCXXGXCXPXXWXCDGXXDCXDNSDEXXXXC

SEQ ID NO: 246 - protein, 35 aa, Artificial Sequence
  Description of Artificial Sequence: Synthetic polypeptide
CPPDQFRCRNGRCVPLAWVCDGEDDCQDNSDETDC

SEQ ID NO: 247 - protein, 37 aa, Artificial Sequence
  Description of Artificial Sequence: Synthetic polypeptide
CAPGEFTCKSGQCIPLHWLCDGDNDCGDNSDESPATC

SEQ ID NO: 248 - protein, 35 aa, Artificial Sequence
  Description of Artificial Sequence: Synthetic polypeptide
CPPGQFRCNNGRCIPQPWLCDGDDDCQDNSDEENC

SEQ ID NO: 249 - protein, 38 aa, Artificial Sequence
  Description of Artificial Sequence: Synthetic consensus polypeptide
  MOD_RES (2)..(2): Ala, Gly, Pro or Arg
  MOD_RES (3)..(3): Ala or Pro
  MOD_RES (4)..(4): Asp, Gly, Asn or Ser
  MOD_RES (5)..(5): Glu or Gln
  MOD_RES (7)..(7): Gln, Arg or Thr
  MOD_RES (9)..(9): Gly, Ser or Lys
  MOD_RES (11)..(11): Gly or Thr
  MOD_RES (12)..(12): Gly, His or Arg
  MOD_RES (13)..(13): Not present or Arg
  MOD_RES (15)..(15): Ile, Leu or Val
  MOD_RES (16)..(16): Pro or Ser
  MOD_RES (17)..(17): Ala, Leu or Gln
  MOD_RES (18)..(18): Asn, Ser or Thr
  MOD_RES (20)..(20): Leu, Arg or Val
  MOD_RES (24)..(24): Asp, Glu or Val
  MOD_RES (28)..(28): Gly or Leu
  MOD_RES (34)..(34): Ala, Glu or Thr
  MOD_RES (35)..(35): Asp, Asn or Ser
  MOD_RES (36)..(36): Not present or Ala
  MOD_RES (37)..(37): Not present or Thr
CXXXXFXCXNXXXCXXXXWXCDGXDDCXDGSDEXXXXC

SEQ ID NO: 250 - protein, 36 aa, Artificial Sequence
  Description of Artificial Sequence: Synthetic polypeptide
CAPGEFTCKNTGRCIPLNWRCDGDDDCGDGSDETDC

SEQ ID NO: 251 - protein, 36 aa, Artificial Sequence
  Description of Artificial Sequence: Synthetic polypeptide
CPADEFRCSNTGRCVPLSWLCDGEDDCGDGSDETNC

SEQ ID NO: 252 - protein, 37 aa, Artificial Sequence
  Description of Artificial Sequence: Synthetic polypeptide
CGPSQFQCSNGRCLPATWVCDGDDDCLDGSDEASATC

SEQ ID NO: 253 - protein, 35 aa, Artificial Sequence
  Description of Artificial Sequence: Synthetic polypeptide
CRPNEFRCGNGHCLSQTWVCDGVDDCLDGSDEESC

SEQ ID NO: 254 - protein, 38 aa, Artificial Sequence
  Description of Artificial Sequence: Synthetic consensus polypeptide
  MOD_RES (2)..(2): Ala, Gly or Pro
  MOD_RES (3)..(3): Ala, Pro or Ser
  MOD_RES (4)..(4): Asp, Gly or Asn
  MOD_RES (5)..(5): Glu or Gln
  MOD_RES (7)..(7): Gln, Arg or Thr
  MOD_RES (9)..(9): Gly, Asn, Arg or Ser
  MOD_RES (10)..(10): Gly, Asn or Ser
  MOD_RES (11)..(11): Gly or Thr
  MOD_RES (12)..(12): Gly, Lys, Gln or Ser
  MOD_RES (13)..(13): Not present, Ile or Lys
  MOD_RES (15)..(15): Ile, Leu or Val
  MOD_RES (17)..(17): Leu, Gln, Arg or Val
  MOD_RES (18)..(18): Ala, Glu, His or Pro
  MOD_RES (20)..(20): Leu, Arg or Val
  MOD_RES (24)..(24): Asp, Leu or Val
  MOD_RES (25)..(25): Asp or Asn
  MOD_RES (30)..(30): Gly or Asn
  MOD_RES (34)..(34): Ala, Glu, Lys, Pro or Ser
  MOD_RES (35)..(35): Gly, Leu, Pro or Ser
  MOD_RES (36)..(36): Not present, Ala, Glu or Val
  MOD_RES (37)..(37): Not present, Ile or Thr
CXXXXFXCXXXXXCXPXXWXCDGXXDCGDXSDEXXXXC

SEQ ID NO: 255 - protein, 37 aa, Artificial Sequence
  Description of Artificial Sequence: Synthetic polypeptide
CGPDQFRCSSGKCIPQHWLCDGLNDCGDGSDESPATC

SEQ ID NO: 256 - protein, 37 aa, Artificial Sequence
  Description of Artificial Sequence: Synthetic polypeptide
CGANEFQCRSTGICVPVEWVCDGDNDCGDGSDEPPVC

SEQ ID NO: 257 - protein, 37 aa, Artificial Sequence
  Description of Artificial Sequence: Synthetic polypeptide
CGADQFRCGNGSCVPRAWRCDGVDDCGDGSDEAPEIC

SEQ ID NO: 258 - protein, 37 aa, Artificial Sequence
  Description of Artificial Sequence: Synthetic polypeptide
CGPDEFRCNNGQCIPLPWRCDGVDDCGDNSDEPLEIC

SEQ ID NO: 259 - protein, 35 aa, Artificial Sequence
  Description of Artificial Sequence: Synthetic polypeptide
CASGEFTCNNGQCVPLAWRCDGVNDCQDGSDEKGC

SEQ ID NO: 260 - protein, 37 aa, Artificial Sequence; identical to SEQ ID NO: 258
  Description of Artificial Sequence: Synthetic polypeptide

SEQ ID NO: 261 - protein, 36 aa, Artificial Sequence
  Description of Artificial Sequence: Synthetic polypeptide
CPPDEFQCRGTKKCLPLAWVCDGDNDCEDDSDEESC

SEQ ID NO: 262 - protein, 35 aa, Artificial Sequence
  Description of Artificial Sequence: Synthetic consensus polypeptide
  MOD_RES (2)..(3): Ala or Pro
  MOD_RES (4)..(4): Gly or Asn
  MOD_RES (7)..(7): Arg or Thr
  MOD_RES (9)..(9): Gly or Arg
  MOD_RES (12)..(12): Asn or Ser
  MOD_RES (16)..(16): Ala or Leu
  MOD_RES (17)..(17): His or Thr
  MOD_RES (19)..(19): Leu or Val
  MOD_RES (27)..(27): Gly or Gln
  MOD_RES (29)..(29): Gly or Asn
  MOD_RES (33)..(33): Glu or Thr
  MOD_RES (34)..(34): Asp or Asn
CXXXQFXCXNGXCIPXXWXCDGDNDCXDXSDEXXC

SEQ ID NO: 263 - protein, 35 aa, Artificial Sequence
  Description of Artificial Sequence: Synthetic polypeptide
CPPGQFRCRNGSCIPATWLCDGDNDCGDNSDEEDC

SEQ ID NO: 264 - protein, 35 aa, Artificial Sequence
  Description of Artificial Sequence: Synthetic polypeptide
CAANQFTCGNGNCIPLHWVCDGDNDCQDGSDETNC

SEQ ID NO: 265 - protein, 38 aa, Artificial Sequence; identical to SEQ ID NO: 74
  Description of Artificial Sequence: Synthetic consensus polypeptide
  MOD_RES (2)..(2): Ala, Pro, Gln or Arg
  MOD_RES (3)..(3): Ala, Ser or Pro
  MOD_RES (4)..(4): Asp or Gly
  MOD_RES (5)..(5): Glu or Gln
  MOD_RES (7)..(7): Pro or Gln
  MOD_RES (9)..(9): Glu, Lys, Asn or Arg
  MOD_RES (10)..(10): Asn or Ser
  MOD_RES (11)..(11): Gly or Thr
  MOD_RES (12)..(12): Gly, His or Asn
  MOD_RES (13)..(13): Not present or Arg
  MOD_RES (15)..(15): Ile, Leu or Val
  MOD_RES (16)..(16): Pro or Ser
  MOD_RES (17)..(17): Ala, Leu, Pro or Arg
  MOD_RES (18)..(18): Ala, Asn, Arg or Thr
  MOD_RES (20)..(20): Leu, Arg or Val
  MOD_RES (24)..(24): Glu or Val
  MOD_RES (25)..(25): Asp or Asn
  MOD_RES (28)..(28): Ala, Gly or Arg
  MOD_RES (30)..(30): Gly, Asn or Ser
  MOD_RES (34)..(34): Ala, Glu, Lys or Ser
  MOD_RES (35)..(35): Gly, Leu, Asn or Ser
  MOD_RES (36)..(36): Not present or Ala
  MOD_RES (37)..(37): Not present or His

SEQ ID NO: 266 - protein, 35 aa, Artificial Sequence
  Description of Artificial Sequence: Synthetic polypeptide
CAPDQFRCKSGNCIPLAWRCDGEDDCRDGSDEESC

SEQ ID NO: 267 - protein, 35 aa, Artificial Sequence
  Description of Artificial Sequence: Synthetic polypeptide
CQAGQFQCESGNCVPPNWLCDGENDCADSSDEANC

SEQ ID NO: 268 - protein, 35 aa, Artificial Sequence
  Description of Artificial Sequence: Synthetic polypeptide
CPSGQFQCNNGHCLSATWLCDGVDDCGDGSDEKGC

SEQ ID NO: 269 - protein, 38 aa, Artificial Sequence
  Description of Artificial Sequence: Synthetic polypeptide
CRPDEFPCRSTGRCVPRRWVCDGVDDCGDNSDESLAHC

SEQ ID NO: 270 - protein, 35 aa, Artificial Sequence
  Description of Artificial Sequence: Synthetic consensus polypeptide
  MOD_RES (4)..(4): Asp or Gly
  MOD_RES (7)..(7): Gln or Arg
  MOD_RES (9)..(9): Gly, Lys or Arg
  MOD_RES (10)..(10): Asn or Ser
  MOD_RES (12)..(12): His or Arg
  MOD_RES (14)..(14): Ile or Val
  MOD_RES (16)..(16): Gly, Leu or Gln
  MOD_RES (17)..(17): Pro or Thr
  MOD_RES (19)..(19): Arg or Val
  MOD_RES (23)..(23): Asp or Glu
  MOD_RES (24)..(24): Asp or Pro
  MOD_RES (29)..(29): Gly or Ser
  MOD_RES (33)..(33): Ala, Glu or Thr
  MOD_RES (34)..(34): Asp, Gly or Asn
CRPXEFXCXXGXCXPXXWXCDGXXDCQDXSDEXXC

SEQ ID NO: 271 - protein, 35 aa, Artificial Sequence
  Description of Artificial Sequence: Synthetic polypeptide
CRPGEFQCGSGHCIPGPWVCDGDPDCQDGSDEANC

SEQ ID NO: 272 - protein, 35 aa, Artificial Sequence
  Description of Artificial Sequence: Synthetic polypeptide
CRPDEFRCKNGRCIPQTWVCDGEDDCQDSSDETDC

SEQ ID NO: 273 - protein, 35 aa, Artificial Sequence
  Description of Artificial Sequence: Synthetic polypeptide
CRPDEFRCRNGRCVPLTWRCDGEDDCQDGSDEEGC

SEQ ID NO: 274 - protein, 37 aa, Artificial Sequence
  Description of Artificial Sequence: Synthetic consensus polypeptide
  MOD_RES (2)..(2): Ala, Gly, Leu or Arg
  MOD_RES (3)..(3): Ala, Pro or Ser
  MOD_RES (4)..(4): Asp, Gly or Asn
  MOD_RES (5)..(5): Glu or Gln
  MOD_RES (7)..(7): Arg, Gln or Thr
  MOD_RES (9)..(9): Gly, His, Lys, Asn, Arg or Ser
  MOD_RES (10)..(10): Asn or Ser
  MOD_RES (11)..(11): Gly, Ser, Thr or Tyr
  MOD_RES (12)..(12): Asp, Glu, Gly, Asn or Arg
  MOD_RES (13)..(13): Not present, Arg or Thr
  MOD_RES (15)..(15): Ile, Leu or Val
  MOD_RES (17)..(17): Ala, Gly, Leu, Pro, Arg or Val
  MOD_RES (18)..(18): Ala, His, Asn, Pro or Thr
  MOD_RES (20)..(20): Leu, Arg or Val
  MOD_RES (24)..(24): Asp, Glu or Val
  MOD_RES (25)..(25): Asp or Asn
  MOD_RES (28)..(28): Ala, Glu, Gly, Arg or Val
  MOD_RES (30)..(30): Asp, Gly or Asn
  MOD_RES (34)..(34): Ala, Glu, Ser or Thr
  MOD_RES (35)..(35): Ala, Asp, Gly, Asn or Ser
  MOD_RES (36)..(36): Not present or Asp
CXXXXFXCXXXXXCXPXXWXCDGXXDCXDXSDEXXXC

SEQ ID NO: 275 - protein, 36 aa, Artificial Sequence
  Description of Artificial Sequence: Synthetic polypeptide
CAPGEFQCSNGNCLPPNWLCDGVDDCGDGSDESADC

SEQ ID NO: 276 - protein, 35 aa, Artificial Sequence
  Description of Artificial Sequence: Synthetic polypeptide
CAPDEFRCRNGNCIPLPWVCDGENDCRDDSDEEDC

SEQ ID NO: 277 - protein, 36 aa, Artificial Sequence
  Description of Artificial Sequence: Synthetic polypeptide
CLSDQFQCNNYETCIPRPWLCDGDDDCVDGSDEEDC

SEQ ID NO: 278 - protein, 35 aa, Artificial Sequence
  Description of Artificial Sequence: Synthetic polypeptide
CAAGEFQCSSGRCLPRPWVCDGDNDCGDDSDETNC

SEQ ID NO: 279 - protein, 35 aa, Artificial Sequence
  Description of Artificial Sequence: Synthetic polypeptide
CRSGEFRCKNGRCIPQHWVCDGENDCGDDSDETNC

SEQ ID NO: 280 - protein, 36 aa, Artificial Sequence
  Description of Artificial Sequence: Synthetic polypeptide
CAAGQFRCHNSDTCLPGAWVCDGDNDCGDNSDEASC

SEQ ID NO: 281 - protein, 36 aa, Artificial Sequence
  Description of Artificial Sequence: Synthetic polypeptide
CAPNEFRCRSTGRCIPVNWVCDGDDDCADNSDEAGC

SEQ ID NO: 282 - protein, 35 aa, Artificial Sequence
  Description of Artificial Sequence: Synthetic polypeptide
CGADQFQCGSGRCVPATWRCDGEDDCGDGSDEENC

SEQ ID NO: 283 - protein, 35 aa, Artificial Sequence
  Description of Artificial Sequence: Synthetic polypeptide
CLPGQFTCGNGRCIPLPWVCDGVNDCEDNSDEESC

SEQ ID NO: 284 - protein, 36 aa, Artificial Sequence
  Description of Artificial Sequence: Synthetic consensus polypeptide
  MOD_RES (2)..(2): Leu or Gln
  MOD_RES (3)..(3): Pro or Ser
  MOD_RES (5)..(5): Glu or Gln
  MOD_RES (9)..(9): Lys or Gln
  MOD_RES (10)..(10): Asn or Thr
  MOD_RES (11)..(11): Gly or Thr
  MOD_RES (13)..(13): Not present or Thr
  MOD_RES (15)..(15): Ile or Leu
  MOD_RES (17)..(17): Leu or Arg
  MOD_RES (18)..(18): Ala or Lys
  MOD_RES (19)..(19): Leu or Trp
  MOD_RES (20)..(20): Leu or Val
  MOD_RES (28)..(28): Glu or Leu
  MOD_RES (34)..(34): Ala or Lys
CXXGXFRCXXXRXCXPXXXXCDGVDDCXDDSDEXDC

SEQ ID NO: 285 - protein, 36 aa, Artificial Sequence
  Description of Artificial Sequence: Synthetic polypeptide
CQSGEFRCQNTRTCLPLKLLCDGVDDCLDDSDEKDC

SEQ ID NO: 286 - protein, 35 aa, Artificial Sequence
  Description of Artificial Sequence: Synthetic polypeptide
CLPGQFRCKTGRCIPRAWVCDGVDDCEDDSDEADC

SEQ ID NO: 287 - protein, 47 aa, Artificial Sequence
  Description of Artificial Sequence: Synthetic polypeptide
CGAGLFTCRSTKICISQAWVCDGVDDCEDNSDEKNCSAPASEPPGSL

SEQ ID NO: 288 - protein, 45 aa, Artificial Sequence
  Description of Artificial Sequence: Synthetic polypeptide
CGAGQFTCRDTNICISRAWRCDGVDDCEDNSDEADCSQDPEFHKV

SEQ ID NO: 289 - protein, 47 aa, Artificial Sequence
  Description of Artificial Sequence: Synthetic polypeptide
CGANQFTCHNTNICISQAWVCDGVDDCEDNSDEKNCSAPASEPPGSL

SEQ ID NO: 290 - protein, 45 aa, Artificial Sequence
  Description of Artificial Sequence: Synthetic polypeptide
CGSNQFTCRSTNICISQAWVCDGVDDCEDDSDETGCSQDPEFHKV

SEQ ID NO: 291 - protein, 47 aa, Artificial Sequence
  Description of Artificial Sequence: Synthetic polypeptide
CLSDQFTCRSTNICLPLQWVCDGDDDCEDNSDEEDCSAPASEPPGSL

SEQ ID NO: 292 - protein, 39 aa, Artificial Sequence
  Description of Artificial Sequence: Synthetic polypeptide
CRLNEFPCGSGSCISLHWVCDSVPDCRDDSDETDCPERT

SEQ ID NO: 293 - protein, 47 aa, Artificial Sequence
  Description of Artificial Sequence: Synthetic polypeptide
CGAGLFTCRSTNICISQVWVCDGVDDCEDNSDEDSCSAPASEPPGSL

SEQ ID NO: 294 - protein, 47 aa, Artificial Sequence
  Description of Artificial Sequence: Synthetic polypeptide
CGAGLFTCRSTNICISQAWVCDGVDDCEDNSDENYCSAPASEPPGSL

SEQ ID NO: 295 - protein, 47 aa, Artificial Sequence
  Description of Artificial Sequence: Synthetic polypeptide
CGAGLFTCRSTNICISQAWVCDGVDDCEDNSDETNCSAPASEPPGSL

SEQ ID NO: 296 - protein, 47 aa, Artificial Sequence
  Description of Artificial Sequence: Synthetic polypeptide
CGASLFTCRRSNICISQAWVCDGVDDCEDNSDEMNCSAPASEPPGSL

SEQ ID NO: 297 - protein, 47 aa, Artificial Sequence
  Description of Artificial Sequence: Synthetic polypeptide
CGEGLFTCRSTNICISHAWVCDGVDDCEDNSDENNCSAPASEPPGSL

SEQ ID NO: 298 - protein, 45 aa, Artificial Sequence
  Description of Artificial Sequence: Synthetic polypeptide
CGANLFTCQSTNICISDAWVCDGVDDCEDNSDETTCSQDPEFHKV

SEQ ID NO: 299 - protein, 45 aa, Artificial Sequence
  Description of Artificial Sequence: Synthetic polypeptide
CGANLFTCRSTNICISPAWVCDGVDDCEDYSDEIGCSQDPEFHKV

SEQ ID NO: 300 - protein, 45 aa, Artificial Sequence
  Description of Artificial Sequence: Synthetic polypeptide
CGSDMFTCRSTNICISKVWVCDGVDDCEDDSDERGCSQDPEFHKV

SEQ ID NO: 301 - protein, 45 aa, Artificial Sequence
  Description of Artificial Sequence: Synthetic polypeptide
CGSNLFTCRRTNICISKAWVCDGVDDCEDNSDETGCSQDPEFHKV

SEQ ID NO: 302 - protein, 45 aa, Artificial Sequence
  Description of Artificial Sequence: Synthetic polypeptide
CGSNLFTCRSTNICISPAWVCDGVDDCDDDSDETGCSQDPEFHKV

SEQ ID NO: 303 - protein, 45 aa, Artificial Sequence
  Description of Artificial Sequence: Synthetic polypeptide
CGTNLFTCRSTNMCISQAWVCDGVDDCEDNSDETVCSQDPEFHKV

SEQ ID NO: 304 - protein, 46 aa, Artificial Sequence
  Description of Artificial Sequence: Synthetic polypeptide
CLPDEFQCGSGRCIPQTWVCDGLNDCGDGSDESPAHCSQDPEFHKV

SEQ ID NO: 305 - protein, 48 aa, Artificial Sequence
  Description of Artificial Sequence: Synthetic polypeptide
CQPDEFTCSSGRCIPQPWLCDGLNDCGDGSDEPPAHCSAPASEPPGSL

SEQ ID NO: 306 - protein, 51 aa, Artificial Sequence
  Description of Artificial Sequence: Synthetic polypeptide
CHSFNQFECRNGQCIPLHLVCDGVPDCGDNSDETDCGDSHILPFSTPGPST

SEQ ID NO: 307 - protein, 87 aa, Artificial Sequence
  Description of Artificial Sequence: Synthetic polypeptide
CLPDEFQCGSGRCIPQHWLCDGLNDCGDGSDEPPAHCSAPASEPPGSLCRAGEFRCSNGRCVPLTWLCDGEDDCQDNSDEKNCAQPT

SEQ ID NO: 308 - protein, 87 aa, Artificial Sequence
  Description of Artificial Sequence: Synthetic polypeptide
CLPDEFQCSSGRCIPQTWVCDGLNDCGDGSDESPAHCSQDPEFHKVCPSSEFRCNNGRCIPLHWVCDGDDDCQDNSDETDCERSGRT

SEQ ID NO: 309 - protein, 92 aa, Artificial Sequence
  Description of Artificial Sequence: Synthetic polypeptide
CLPDEFQCGSGRCIPQTWVCDGLNDCGDGSDESPAHCSQDPEFHKVCRPGEFRCNNGRCVPQTWVCDGEDDCGDNSDETDCSAPASEPPGSL

SEQ ID NO: 310 - protein, 85 aa, Artificial Sequence
  Description of Artificial Sequence: Synthetic polypeptide
CLPDEFQCGSGRCIPQTWVCDGLNDCGDGSDESPAHCSQDPEFHKVCQPNEFQCGNGRCIPAQWLCDGEDDCQDNSDEEDCTEHT

SEQ ID NO: 311 - protein, 84 aa, Artificial Sequence
  Description of Artificial Sequence: Synthetic polypeptide
CPADEFRCSNTGRCVPLSWLCDGEDDCGDGSDETNCKAHTCPSNQFPCRSTGICIPLAWVCDGLNDCGDGSDESPATCKAPVPT

SEQ ID NO: 312 - protein, 88 aa, Artificial Sequence
  Description of Artificial Sequence: Synthetic polypeptide
CGADQFRCGNGSCVPRAWRCDGVDDCGDGSDEAPEICETPTCQSNEFRCRSGRCIPQHWLCDGLNDCGDGSDESQQCSAPASEPPGSL

SEQ ID NO: 313 - protein, 87 aa, Artificial Sequence
  Description of Artificial Sequence: Synthetic polypeptide
CLPDEFRCGNGNCISVAWRCDGVDDCEDGSDEEDCESPEHTCQSNEFRCRSGRCIPQHWLCDGLNDCGDGSDESPAHCSQDPEFHKV

SEQ ID NO: 314 - protein, 93 aa, Artificial Sequence
  Description of Artificial Sequence: Synthetic polypeptide
CGANQFTCHNTNICISQAWVCDGVDDCEDNSDEKNCSAPASEPPGSLCLPDEFQCGSGRCIPQTWVCDGLNDCGDGSDESPAHCSQDPEFHKV

SEQ ID NO: 315 - protein, 98 aa, Artificial Sequence
  Description of Artificial Sequence: Synthetic polypeptide
CGANQFTCHNTNICISQAWVCDGVDDCEDNSDEKNCSAPASEPPGSLGGGGSCLPDEFQCGSGRCIPQTWVCDGLNDCGDGSDESPAHCSQDPEFHKV

SEQ ID NO: 316 - protein, 103 aa, Artificial Sequence
  Description of Artificial Sequence: Synthetic polypeptide
CGANQFTCHNTNICISQAWVCDGVDDCEDNSDEKNCSAPASEPPGSLGGGGSGGGGSCLPDEFQCGSGRCIPQTWVCDGLNDCGDGSDESPAHCSQDPEFHKV

SEQ ID NO: 317 - protein, 108 aa, Artificial Sequence
  Description of Artificial Sequence: Synthetic polypeptide
CGANQFTCHNTNICISQAWVCDGVDDCEDNSDEKNCSAPASEPPGSLGGGGSGGGGSGGGGSCLPDEFQCGSGRCIPQTWVCDGLNDCGDGSDESPAHCSQDPEFHKV

SEQ ID NO: 318 - protein, 93 aa, Artificial Sequence
  Description of Artificial Sequence: Synthetic polypeptide
CLPDEFQCGSGRCIPQTWVCDGLNDCGDGSDESPAHCSQDPEFHKVCGANQFTCHNTNICISQAWVCDGVDDCEDNSDEKNCSAPASEPPGSL

SEQ ID NO: 319 - protein, 105 aa, Artificial Sequence
  Description of Artificial Sequence: Synthetic polypeptide
CLPDEFQCGSGRCIPQTWVCDGLNDCGDGSDESPAHCSQDPELHKVSLGGGGSGGGGSCGANQFTCHNTNICISQAWVCDGVDDCEDNSDEKNCSAPASEPPGSL

SEQ ID NO: 320 - protein, 110 aa, Artificial Sequence
  Description of Artificial Sequence: Synthetic polypeptide
CLPDEFQCGSGRCIPQTWVCDGLNDCGDGSDESPAHCSQDPELHKVSLGGGGSGGGGSGGGGSCGANQFTCHNTNICISQAWVCDGVDDCEDNSDEKNCSAPASEPPGSL

SEQ ID NO: 321 - protein, 95 aa, Artificial Sequence
  Description of Artificial Sequence: Synthetic polypeptide
CGANQFTCHNTNICISQAWVCDGVDDCEDNSDEKNCSAPASEPPGSLCQPDEFTCSSGRCIPQPWLCDGLNDCGDGSDEPPAHCSAPASEPPGSL

SEQ ID NO: 322 - protein, 100 aa, Artificial Sequence
  Description of Artificial Sequence: Synthetic polypeptide
CGANQFTCHNTNICISQAWVCDGVDDCEDNSDEKNCSAPASEPPGSLGGGGSCQPDEFTCSSGRCIPQPWLCDGLNDCGDGSDEPPAHCSAPASEPPGSL

SEQ ID NO: 323 - protein, 105 aa, Artificial Sequence
  Description of Artificial Sequence: Synthetic polypeptide
CGANQFTCHNTNICISQAWVCDGVDDCEDNSDEKNCSAPASEPPGSLGGGGSGGGGSCQPDEFTCSSGRCIPQPWLCDGLNDCGDGSDEPPAHCSAPASEPPGSL

SEQ ID NO: 324 - protein, 110 aa, Artificial Sequence
  Description of Artificial Sequence: Synthetic polypeptide
CGANQFTCHNTNICISQAWVCDGVDDCEDNSDEKNCSAPASEPPGSLGGGGSGGGGSGGGGSCQPDEFTCSSGRCIPQPWLCDGLNDCGDGSDEPPAHCSAPASEPPGSL

SEQ ID NO: 325 - protein, 95 aa, Artificial Sequence
  Description of Artificial Sequence: Synthetic polypeptide
CQPDEFTCSSGRCIPQPWLCDGLNDCGDGSDEPPAHCSAPASEPPGSLCGANQFTCHNTNICISQAWVCDGVDDCEDNSDEKNCSAPASEPPGSL

SEQ ID NO: 326 - protein, 102 aa, Artificial Sequence
  Description of Artificial Sequence: Synthetic polypeptide
CQPDEFTCSSGRCIPQPWLCDGLNDCGDGSDEPPAHCSAPASEPPGSLSLGGGGSCGANQFTCHNTNICISQAWVCDGVDDCEDNSDEKNCSAPASEPPGSL

SEQ ID NO: 327 - protein, 107 aa, Artificial Sequence
  Description of Artificial Sequence: Synthetic polypeptide
CQPDEFTCSSGRCIPQPWLCDGLNDCGDGSDEPPAHCSAPASEPPGSLSLGGGGSGGGGSCGANQFTCHNTNICISQAWVCDGVDDCEDNSDEKNCSAPASEPPGSL

SEQ ID NO: 328 - protein, 114 aa, Artificial Sequence
  Description of Artificial Sequence: Synthetic polypeptide
CQPDEFTCSSGRCIPQPWLCDGLNDCGDGSDEPPAHCSAPASEPPGSLSLGGGGSGGGGSGGGGLFMCGANQFTCHNTNICISQAWVCDGVDDCEDNSDEKNCSAPASEPPGSL

SEQ ID NO: 329 - protein, 98 aa, Artificial Sequence
  Description of Artificial Sequence: Synthetic polypeptide
CGANQFTCHNTNICISQAWVCDGVDDCEDNSDEKNCSAPASEPPGSLCHSFNQFECRNGQCIPLHLVCDGVPDCGDNSDETDCGDSHILPFSTPGPST

SEQ ID NO: 330 - protein, 103 aa, Artificial Sequence
  Description of Artificial Sequence: Synthetic polypeptide
CGANQFTCHNTNICISQAWVCDGVDDCEDNSDEKNCSAPASEPPGSLGGGGSCHSFNQFECRNGQCIPLHLVCDGVPDCGDNSDETDCGDSHILPFSTPGPST

SEQ ID NO: 331 - protein, 108 aa, Artificial Sequence
  Description of Artificial Sequence: Synthetic polypeptide
CGANQFTCHNTNICISQAWVCDGVDDCEDNSDEKNCSAPASEPPGSLGGGGSGGGGSCHSFNQFECRNGQCIPLHLVCDGVPDCGDNSDETDCGDSHILPFSTPGPST

SEQ ID NO: 332 - protein, 113 aa, Artificial Sequence
  Description of Artificial Sequence: Synthetic polypeptide
CGANQFTCHNTNICISQAWVCDGVDDCEDNSDEKNCSAPASEPPGSLGGGGSGGGGSGGGGSCHSFNQFECRNGQCIPLHLVCDGVPDCGDNSDETDCGDSHILPFSTPGPST

SEQ ID NO: 333 - protein, 98 aa, Artificial Sequence
  Description of Artificial Sequence: Synthetic polypeptide
CHSFNQFECRNGQCIPLHLVCDGVPDCGDNSDETDCGDSHILPFSTPGPSTCGANQFTCHNTNICISQAWVCDGVDDCEDNSDEKNCSAPASEPPGSL

SEQ ID NO: 334 - protein, 103 aa, Artificial Sequence
  Description of Artificial Sequence: Synthetic polypeptide
CHSFNQFECRNGQCIPLHLVCDGVPDCGDNSDETDCGDSHILPFSTPGPSTGGGGSCGANQFTCHNTNICISQAWVCDGVDDCEDNSDEKNCSAPASEPPGSL

SEQ ID NO: 335 - protein, 134 aa, Artificial Sequence
  Description of Artificial Sequence: Synthetic polypeptide
CLPDEFQCGSGRCIPQHWLCDGLNDCGDGSDEPPAHCSAPASEPPGSLCRAGEFRCSNGRCVPLTWLCDGEDDCQDNSDEKNCAQPTCGAGLFTCRSTNICISQVWVCDGVDDCEDNSDEDSCSAPASEPPGSL

SEQ ID NO: 336 - protein, 134 aa, Artificial Sequence
  Description of Artificial Sequence: Synthetic polypeptide
CLPDEFQCGSGRCIPQHWLCDGLNDCGDGSDEPPAHCSAPASEPPGSLCRAGEFRCSNGRCVPLTWLCDGEDDCQDNSDEKNCAQPTCGAGLFTCRSTNICISQAWVCDGVDDCEDNSDENYCSAPASEPPGSL

SEQ ID NO: 337 - protein, 134 aa, Artificial Sequence
  Description of Artificial Sequence: Synthetic polypeptide
CLPDEFQCGSGRCIPQHWLCDGLNDCGDGSDEPPAHCSAPASEPPGSLCRAGEFRCSNGRCVPLTWLCDGEDDCQDNSDEKNCAQPTCGAGLFTCRSTNICISQAWVCDGVDDCEDNSDETNCSAPASEPPGSL

SEQ ID NO: 338 - protein, 134 aa, Artificial Sequence
  Description of Artificial Sequence: Synthetic polypeptide
CLPDEFQCGSGRCIPQHWLCDGLNDCGDGSDEPPAHCSAPASEPPGSLCRAGEFRCSNGRCVPLTWLCDGEDDCQDNSDEKNCAQPTCGASLFTCRRSNICISQAWVCDGVDDCEDNSDEMNCSAPASEPPGSL

SEQ ID NO: 339 - protein, 134 aa, Artificial Sequence
  Description of Artificial Sequence: Synthetic polypeptide
CLPDEFQCGSGRCIPQHWLCDGLNDCGDGSDEPPAHCSAPASEPPGSLCRAGEFRCSNGRCVPLTWLCDGEDDCQDNSDEKNCAQPTCGEGLFTCRSTNICISHAWVCDGVDDCEDNSDENNCSAPASEPPGSL

SEQ ID NO: 340 - protein, 132 aa, Artificial Sequence
  Description of Artificial Sequence: Synthetic polypeptide
CLPDEFQCGSGRCIPQHWLCDGLNDCGDGSDEPPAHCSAPASEPPGSLCRAGEFRCSNGRCVPLTWLCDGEDDCQDNSDEKNCAQPTCGANLFTCQSSNICISDAWVCDGVDDCEDNSDETTCSQDPEFHKV

SEQ ID NO: 341 - protein, 132 aa, Artificial Sequence
  Description of Artificial Sequence: Synthetic polypeptide
CLPDEFQCGSGRCIPQHWLCDGLNDCGDGSDEPPAHCSAPASEPPGSLCRAGEFRCSNGRCVPLTWLCDGEDDCQDNSDEKNCAQPTCGANLFTCRSTNICISPAWVCDGVDDCEDYSDEIGCSQDPEFHKV

SEQ ID NO: 342 - protein, 132 aa, Artificial Sequence
  Description of Artificial Sequence: Synthetic polypeptide
CLPDEFQCGSGRCIPQHWLCDGLNDCGDGSDEPPAHCSAPASEPPGSLCRAGEFRCSNGRCVPLTWLCDGEDDCQDNSDEKNCAQPTCGSDMFTCRSTNICISKVWVCDGVDDCEDDSDERGCSQDPEFHKV

SEQ ID NO: 343 - protein, 132 aa, Artificial Sequence
  Description of Artificial Sequence: Synthetic polypeptide
CLPDEFQCGSGRCIPQHWLCDGLNDCGDGSDEPPAHCSAPASEPPGSLCRAGEFRCSNGRCVPLTWLCDGEDDCQDNSDEKNCAQPTCGSNLFTCRRTNICISKAWVCDGVDDCEDNSDETGCSQDPEFHKV

SEQ ID NO: 344 - protein, 132 aa, Artificial Sequence
  Description of Artificial Sequence: Synthetic polypeptide
CLPDEFQCGSGRCIPQHWLCDGLNDCGDGSDEPPAHCSAPASEPPGSLCRAGEFRCSNGRCVPLTWLCDGEDDCQDNSDEKNCAQPTCGSNLFTCRSTNICISPAWVCDGVDDCDDDSDETGCSQDPEFHKV

SEQ ID NO: 345 - protein, 132 aa, Artificial Sequence
  Description of Artificial Sequence: Synthetic polypeptide
CLPDEFQCGSGRCIPQHWLCDGLNDCGDGSDEPPAHCSAPASEPPGSLCRAGEFRCSNGRCVPLTWLCDGEDDCQDNSDEKNCAQPTCGTNLFTCRSTNMCISQAWVCDGVDDCEDNSDETVCSQDPEFHKV

SEQ ID NO: 346 - protein, 139 aa, Artificial Sequence
  Description of Artificial Sequence: Synthetic polypeptide
CLPDEFQCGSGRCIPQTWVCDGLNDCGDGSDESPAHCSQDPEFHKVCRPGEFRCNNGRCVPQTWVCDGEDDCGDNSDETDCSAPASEPPGSLCGANQFTCHNTNICISQAWVCDGVDDCEDNSDEKNCSAPASEPPGSL

SEQ ID NO: 347 - protein, 132 aa, Artificial Sequence
  Description of Artificial Sequence: Synthetic polypeptide
CLPDEFQCGSGRCIPQTWVCDGLNDCGDGSDESPAHCSQDPEFHKVCQPNEFQCGNGRCIPAQWLCDGEDDCQDNSDEEDCTEHTCGANQFTCHNTNICISQAWVCDGVDDCEDNSDEKNCSAPASEPPGSL

SEQ ID NO: 348 - protein, 131 aa, Artificial Sequence
  Description of Artificial Sequence: Synthetic polypeptide
CPADEFRCSNTGRCVPLSWLCDGEDDCGDGSDETNCKAHTCPSNQFPCRSTGICIPLAWVCDGLNDCGDGSDESPATCKAPVPTCGANQFTCHNTNICISQAWVCDGVDDCEDNSDEKNCSAPASEPPGSL

SEQ ID NO: 349 - protein, 135 aa, Artificial Sequence
  Description of Artificial Sequence: Synthetic polypeptide
CGADQFRCGNGSCVPRAWRCDGVDDCGDGSDEAPEICETPTCQSNEFRCRSGRCIPQHWLCDGLNDCGDGSDESQQCSAPASEPPGSLCGANQFTCHNTNICISQAWVCDGVDDCEDNSDEKNCSAPASEPPGSL

SEQ ID NO: 350 - protein, 132 aa, Artificial Sequence
  Description of Artificial Sequence: Synthetic polypeptide
CLPDEFQCGSGRCIPQTWVCDGLNDCGDGSDESPAHCSQDPEFHKVCQPNEFQCGNGRCIPAQWLCDGEDDCQDNSDEEDCTEHTCGASLFTCRRSNICISQAWVCDGVDDCEDNTDEMNCSAPASEPPGSL

SEQ ID NO: 351 - protein, 132 aa, Artificial Sequence
  Description of Artificial Sequence: Synthetic polypeptide
CLPDEFQCGSGRCIPQTWVCDGLNDCGDGSDESPAHCSQDPEFHKVCQPNEFQCGNGRCIPAQWLCDGEDDCQDNSDEEDCTEHTCGEGLFTCRSTNICISHAWVCDGVDDCEDNSDENNCSAPASEPPGSL

SEQ ID NO: 352 - protein, 130 aa, Artificial Sequence
  Description of Artificial Sequence: Synthetic polypeptide
CLPDEFQCGSGRCIPQTWVCDGLNDCGDGSDESPAHCSQDPEFHKVCQPNEFQCGNGRCIPAQWLCDGEDDCQDNSDEEDCTEHTCGANLFTCRSTNICISPAWVCDGVDDCEDYSDEIGCSQDPEFHKV

SEQ ID NO: 353 - protein, 130 aa, Artificial Sequence
  Description of Artificial Sequence: Synthetic polypeptide
CLPDEFQCGSGRCIPQTWVCDGLNDCGDGSDESPAHCSQDPEFHKVCQPNEFQCGNGRCIPAQWLCDGEDDCQDNSDEEDCTEHTCGTNLFTCRSTNMCISQAWVCDGVDDCEDNSDETVCSQDPEFHKV

SEQ ID NO: 354 - protein, 131 aa, Artificial Sequence
  Description of Artificial Sequence: Synthetic polypeptide
CPADEFRCSNTGRCVPLSWLCDGEDDCGDGSDETNCKAHTCPSNQFPCRSTGICIPLAWVCDGLNDCGDGSDESPATCKAPVPTCGASLFTCRRSNICISQAWVCDGVDDCEDNSDEMNCSAPASEPPGSL

SEQ ID NO: 355 - protein, 131 aa, Artificial Sequence
  Description of Artificial Sequence: Synthetic polypeptide
CPADEFRCSNTGRCVPLSWLCDGEDDCGDGSDETNCKAHTCPSNQFPCRSTGICIPLAWVCDGLNDCGDGSDESPATCKAPVPTCGEGLFTCRSTNICISHAWVCDGVDDCEDNSDENNCSAPASEPPGSL

SEQ ID NO: 356 - protein, 129 aa, Artificial Sequence
  Description of Artificial Sequence: Synthetic polypeptide
CPADEFRCSNTGRCVPLSWLCDGEDDCGDGSDETNCKAHTCPSNQFPCRSTGICIPLAWVCDGLNDCGDGSDESPATCKAPVPTCGANLFTCRSTNICISPAWVCDGVDDCEDYSDEIGCSQDPEFHKV

SEQ ID NO: 357 - protein, 129 aa, Artificial Sequence
  Description of Artificial Sequence: Synthetic polypeptide
CPADEFRCSNTGRCVPLSWLCDGEDDCGDGSDETNCKAHTCPSNQFPCRSTGICIPLAWVCDGLNDCGDGSDESPATCKAPVPTCGTNLFTCRSTNMCISQAWVCDGVDDCEDNSDETVCSQDPEFHKV

SEQ ID NO: 358 - protein, 135 aa, Artificial Sequence
  Description of Artificial Sequence: Synthetic polypeptide
CGADQFRCGNGSCVPRAWRCDGVDDCGDGSDEAPEICETPTCQSNEFRCRSGRCIPQHWLCDGLNDCGDGSDESQQCSAPASEPPGSLCGASLFTCRRSNICISQAWVCDGVDDCEDNSDEMNCSAPASEPPGSL

SEQ ID NO: 359 - protein, 135 aa, Artificial Sequence
  Description of Artificial Sequence: Synthetic polypeptide
CGADQFRCGNGSCVPRAWRCDGVDDCGDGSDEAPEICETPTCQSNEFRCRSGRCIPQHWLCDGLNDCGDGSDESQQCSAPASEPPGSLCGEGLFTCRSTNICISHAWVCDGVDDCEDNSDENNCSAPASEPPGSL

SEQ ID NO: 360 - protein, 133 aa, Artificial Sequence
  Description of Artificial Sequence: Synthetic polypeptide
CGADQFRCGNGSCVPRAWRCDGVDDCGDGSDEAPEICETPTCQSNEFRCRSGRCIPQHWLCDGLNDCGDGSDESQQCSAPASEPPGSLCGANLFTCRSTNICISPAWVCDGVDDCEDYSDEIGCSQDPEFHKV

SEQ ID NO: 361 - protein, 133 aa, Artificial Sequence
  Description of Artificial Sequence: Synthetic polypeptide
CGADQFRCGNGSCVPRAWRCDGVDDCGDGSDEAPEICETPTCQSNEFRCRSGRCIPQHWLCDGLNDCGDGSDESQQCSAPASEPPGSLCGTNLFTCRSTNMCISQAWVCDGVDDCEDNSDETVCSQDPEFHKV

SEQ ID NO: 362 - protein, 131 aa, Artificial Sequence
  Description of Artificial Sequence: Synthetic polypeptide
CGASLFTCRRSNICISQAWVCDGVDDCEDNSDEMNCSAPASEPPGSLCPADEFRCSNTGRCVPLSWLCDGEDDCGDGSDETNCKAHTCPSNQFPCRSTGICIPLAWVCDGLNDCGDGSDESPATCKAPVPT

SEQ ID NO: 363 - protein, 131 aa, Artificial Sequence
  Description of Artificial Sequence: Synthetic polypeptide
CGEGLFTCRSTNICISHAWVCDGVDDCEDNSDENNCSAPASEPPGSLCPADEFRCSNTGRCVPLSWLCDGEDDCGDGSDETNCKAHTCPSNQFPCRSTGICIPLAWVCDGLNDCGDGSDESPATCKAPVPT

SEQ ID NO: 364 - protein, 129 aa, Artificial Sequence
  Description of Artificial Sequence: Synthetic polypeptide
CGANLFTCRSTNICISPAWVCDGVDDCEDYSDEIGCSQDPEFHKVCPADEFRCSNTGRCVPLSWLCDGEDDCGDGSDETNCKAHTCPSNQFPCRSTGICIPLAWVCDGLNDCGDGSDESPATCKAPVPT

SEQ ID NO: 365 - protein, 129 aa, Artificial Sequence
  Description of Artificial Sequence: Synthetic polypeptide
CGTNLFTCRSTNMCISQAWVCDGVDDCEDNSDETVCSQDPEFHKVCPADEFRCSNTGRCVPLSWLCDGEDDCGDGSDETNCKAHTCPSNQFPCRSTGICIPLAWVCDGLNDCGDGSDESPATCKAPVPT

SEQ ID NO: 366 - protein, 135 aa, Artificial Sequence
  Description of Artificial Sequence: Synthetic polypeptide
CGASLFTCRRSNICISQAWVCDGVDDCEDNSDEMNCSAPASEPPGSLCGADQFRCGNGSCVPRAWRCDGVDDCGDGSDEAPEICETPTCQSNEFRCRSGRCIPQHWLCDGLNDCGDGSDESQQCSAPASEPPGSL

SEQ ID NO: 367 - protein, 135 aa, Artificial Sequence
  Description of Artificial Sequence: Synthetic polypeptide
CGEGLFTCRSTNICISHAWVCDGVDDCEDNSDENNCSAPASEPPGSLCGADQFRCGNGSCVPRAWRCDGVDDCGDGSDEAPEICETPTCQSNEFRCRSGRCIPQHWLCDGLNDCGDGSDESQQCSAPASEPPGSL

SEQ ID NO: 368 - protein, 133 aa, Artificial Sequence
  Description of Artificial Sequence: Synthetic polypeptide
CGANLFTCRSTNICISPAWVCDGVDDCEDYSDEIGCSQDPEFHKVCGADQFRCGNGSCVPRAWRCDGVDDCGDGSDEAPEICETPTCQSNEFRCRSGRCIPQHWLCDGLNDCGDGSDESQQCSAPASEPPGSL

SEQ ID NO: 369 - protein, 133 aa, Artificial Sequence
  Description of Artificial Sequence: Synthetic polypeptide
CGTNLFTCRSTNMCISQAWVCDGVDDCEDNSDETVCSQDPEFHKVCGADQFRCGNGSCVPRAWRCDGVDDCGDGPDEAPEICETPTCQSNEFRCRSGRCIPQHWLCDGLNDCGDGSDESQQCSAPASEPPGSL

SEQ ID NO: 370 - protein, 134 aa, Artificial Sequence
  Description of Artificial Sequence: Synthetic polypeptide
CGAGLFTCRSTKICISQAWVCDGVDDCEDNSDEKNCSAPASEPPGSLCLPDEFQCGSGRCIPQHWLCDGLNDCGDGSDEPPAHCSAPASEPPGSLCRAGEFRCSNGRCVPLTWLCDGEDDCQDNSDEKNCAQPT

SEQ ID NO: 371 - protein, 134 aa, Artificial Sequence
  Description of Artificial Sequence: Synthetic polypeptide
CGAGLFTCRSTKICISQAWVCDGVDDCEDNSDEKNCSAPASEPPGSLCLPDEFQCSSGRCIPQTWVCDGLNDCGDGSDESPAHCSQDPEFHKVCPSSEFRCNNGRCIPLHWVCDGDDDCQDNSDETDCERSGRT

SEQ ID NO: 372 - protein, 134 aa, Artificial Sequence
  Description of Artificial Sequence: Synthetic polypeptide
CLPDEFQCSSGRCIPQTWVCDGLNDCGDGSDESPAHCSQDPEFHKVCPSSEFRCNNGRCIPLHWVCDGDDDCQDNSDETDCERSGRTCGAGLFTCRSTKICISQAWVCDGVDDCEDNSDEKNCSAPASEPPGSL

SEQ ID NO: 373 - protein, 136 aa, Artificial Sequence
  Description of Artificial Sequence: Synthetic polypeptide
CGAGLFTCRSTKICISQAWVCDGVDDCEDNSDEKNCSAPASEPPGSLCGPDEFRCNNGQCIPLPWRCDGVDDCGDNSDEPLEICQAPTCQSNEFRCRSGRCIPQHWLCDGLNDCGDGSDEPPAHCSAPASEPPGSL

SEQ ID NO: 374 - protein, 132 aa, Artificial Sequence
  Description of Artificial Sequence: Synthetic polypeptide
CGAGQFTCRDTNICISRAWRCDGVDDCEDNSDEADCSQDPEFHKVCLPDEFQCGSGRCIPQHWLCDGLNDCGDGSDEPPAHCSAPASEPPGSLCRAGEFRCSNGRCVPLTWLCDGEDDCQDNSDEKNCAQPT

SEQ ID NO: 375 - protein, 132 aa, Artificial Sequence
  Description of Artificial Sequence: Synthetic polypeptide
CLPDEFQCGSGRCIPQHWLCDGLNDCGDGSDEPPAHCSAPASEPPGSLCRAGEFRCSNGRCVPLTWLCDGEDDCQDNSDEKNCAQPTCGAGQFTCRDTNICISRAWRCDGVDDCEDNSDEADCSQDPEFHKV

SEQ ID NO: 376 - protein, 132 aa, Artificial Sequence
  Description of Artificial Sequence: Synthetic polypeptide
CGAGQFTCRDTNICISRAWRCDGVDDCEDNSDEADCSQDPEFHKVCLPDEFQCSSGRCIPQTWVCDGLNDCGDGSDESPAHCSQDPEFHKVCPSSEFRCNNGRCIPLHWVCDGDDDCQDNSDETDCERSGRT

SEQ ID NO: 377 - protein, 132 aa, Artificial Sequence
  Description of Artificial Sequence: Synthetic polypeptide
CLPDEFQCSSGRCIPQTWVCDGLNDCGDGSDESPAHCSQDPEFHKVCPSSEFRCNNGRCIPLHWVCDGDDDCQDNSDETDCERSGRTCGAGQFTCRDTNICISRAWRCDGVDDCEDNSDEADCSQDPEFHKV

SEQ ID NO: 378 - protein, 134 aa, Artificial Sequence
  Description of Artificial Sequence: Synthetic polypeptide
CGAGQFTCRDTNICISRAWRCDGVDDCEDNSDEADCSQDPEFHKVCGPDEFRCNNGQCIPLPWRCDGVDDCGDNSDEPLEICQAPTCQSNEFRCRSGRCIPQHWLCDGLNDCGDGSDEPPAHCSAPASEPPGSL

SEQ ID NO: 379 - protein, 134 aa, Artificial Sequence
  Description of Artificial Sequence: Synthetic polypeptide
CGANQFTCHNTNICISQAWVCDGVDDCEDNSDEKNCSAPASEPPGSLCLPDEFQCGSGRCIPQHWLCDGLNDCGDGSDEPPAHCSAPASEPPGSLCRAGEFRCSNGRCVPLTWLCDGEDDCQDNSDEKNCAQPT

SEQ ID NO: 380 - protein, 136 aa, Artificial Sequence
  Description of Artificial Sequence: Synthetic polypeptide
CLSDQFTCRSTNICLPLQWVCDGDDDCEDNSDEEDCSAPASEPPGSLCGPDEFRCNNGQCIPLPWRCDGVDDCGDNSDEPLEICQAPTCQSNEFRCRSGRCIPQHWLCDGLNDCGDGSDEPPAHCSAPASEPPGSL

SEQ ID NO: 381 - protein, 134 aa, Artificial Sequence
  Description of Artificial Sequence: Synthetic polypeptide
CGANQFTCHNTNICISQAWVCDGVDDCEDNSDEKNCSAPASEPPGSLCLPDEFQCSSGRCIPQTWVCDGLNDCGDGSDESPAHCSQDPEFHKVCPSSEFRCNNGRCIPLHWVCDGDDDCQDNSDETDCERSGRT

SEQ ID NO: 382 - protein, 134 aa, Artificial Sequence
  Description of Artificial Sequence: Synthetic polypeptide
CLPDEFQCSSGRCIPQTWVCDGLNDCGDGSDESPAHCSQDPEFHKVCPSSEFRCNNGRCIPLHWVCDGDDDCQDNSDETDCERSGRTCGANQFTCHNTNICISQAWVCDGVDDCEDNSDEKNCSAPASEPPGSL

SEQ ID NO: 383 - protein, 136 aa, Artificial Sequence
  Description of Artificial Sequence: Synthetic polypeptide
CGANQFTCHNTNICISQAWVCDGVDDCEDNSDEKNCSAPASEPPGSLCGPDEFRCNNGQCIPLPWRCDGVDDCGDNSDEPLEICQAPTCQSNEFRCRSGRCIPQHWLCDGLNDCGDGSDEPPAHCSAPASEPPGSL

SEQ ID NO: 384 - protein, 132 aa, Artificial Sequence
  Description of Artificial Sequence: Synthetic polypeptide
CLPDEFQCGSGRCIPQHWLCDGLNDCGDGSDEPPAHCSAPASEPPGSLCRAGEFRCSNGRCVPLTWLCDGEDDCQDNSDEKNCAQPTCGSNQFTCRSTNICISQAWVCDGVDDCEDDSDETGCSQDPEFHKV

SEQ ID NO: 385 - protein, 132 aa, Artificial Sequence
  Description of Artificial Sequence: Synthetic polypeptide
CGSNQFTCRSTNICISQAWVCDGVDDCEDDSDETGCSQDPEFHKVCLPDEFQCSSGRCIPQTWVCDGLNDCGDGSDESPAHCSQDPEFHKVCPSSEFRCNNGRCIPLHWVCDGDDDCQDNSDETDCERSGRT

SEQ ID NO: 386 - protein, 132 aa, Artificial Sequence
  Description of Artificial Sequence: Synthetic polypeptide
CLPDEFQCSSGRCIPQTWVCDGLNDCGDGSDESPAHCSQDPEFHKVCPSSEFRCNNGRCIPLHWVCDGDDDCQDNSDETDCERSGRTCGSNQFTCRSTNICISQAWVCDGVDDCEDDSDETGCSQDPEFHKV

SEQ ID NO: 387 - protein, 134 aa, Artificial Sequence
  Description of Artificial Sequence: Synthetic polypeptide
CLPDEFQCGSGRCIPQHWLCDGLNDCGDGSDEPPAHCSAPASEPPGSLCRAGEFRCSNGRCVPLTWLCDGEDDCQDNSDEKNCAQPTCLSDQFTCRSTNICLPLQWVCDGDDDCEDNSDEEDCSAPASEPPGSL

SEQ ID NO: 388 - protein, 136 aa, Artificial Sequence
  Description of Artificial Sequence: Synthetic polypeptide
CAAGQFRCHNSDTCLPGAWVCDGDNDCGDNSDEASCQKRTCHSFNQFECRNGQCIPLHLVCDGVPDCGDNSDETDCGDSHILPFSTPGPSTCGAGQFTCRDTNICISRAWRCDGVDDCEDNSDEADCSQDPEFHKV

SEQ ID NO: 389 - protein, 132 aa, Artificial Sequence
  Description of Artificial Sequence: Synthetic polypeptide
CAPDQFRCSSGQCIPETWLCDGDDDCVDSSDEAGCASTVPTCLPDEFQCGSGRCIPQTWVCDGLNDCGDGSDESPAHCSQDPEFHKVCGAGQFTCRDTNICISRAWRCDGVDDCEDNSDEADCSQDPEFHKV

SEQ ID NO: 390 - protein, 134 aa, Artificial Sequence
  Description of Artificial Sequence: Synthetic polypeptide
CLPDEFQCGSGRCIPQHWLCDGLNDCGDGSDEPPAHCSAPASEPPGSLCRAGEFRCSNGRCVPLTWLCDGEDDCQDNSDEKNCAQPTCGANQFTCHNTNICISQAWVCDGVDDCEDNSDEKNCSAPASEPPGSL

SEQ ID NO: 391 - protein, 134 aa, Artificial Sequence
  Description of Artificial Sequence: Synthetic polypeptide
CGANQFTCHNTNICISQAWVCDGVDDCEDNSDEKNCSAPASEPPGSLCLPDEFRCGNGNCISVAWRCDGVDDCEDGSDEEDCESPEHTCQSNEFRCRSGRCIPQHWLCDGLNDCGDGSDESPAHCSQDPEFHKV

SEQ ID NO: 392 - protein, 134 aa, Artificial Sequence
  Description of Artificial Sequence: Synthetic polypeptide
CGANQFTCHNTNICISQAWVCDGVDDCEDNSDEKNCSAPASEPPGSLCAPDQFRCSSGQCIPETWLCDGDDDCVDSSDEAGCASTVPTCLPDEFQCGSGRCIPQTWVCDGLNDCGDGSDESPAHCSQDPEFHKV

SEQ ID NO: 393 - protein, 6 aa, Artificial Sequence
  Description of Artificial Sequence: Synthetic 6xHis tag
HHHHHH

SEQ ID NO: 394 - protein, 37 aa, Artificial Sequence
  Description of Artificial Sequence: Synthetic consensus polypeptide
  MOD_RES (33)..(33): Pro or Ser
  MOD_RES (34)..(34): Pro or Gln
  MOD_RES (35)..(35): Ala or Gln
  MOD_RES (36)..(36): Not present or His
CQSNEFRCRSGRCIPQHWLCDGLNDCGDGSDEXXXXC

SEQ ID NO: 395 - DNA, 63 bp, Artificial Sequence
  Description of Artificial Sequence: Synthetic oligonucleotide
agcttataacttcgtatagaaaggtatatacgaagttatagatctcgtgctgcatgcggtgcg

SEQ ID NO: 396 - DNA, 67 bp, Artificial Sequence
  Description of Artificial Sequence: Synthetic oligonucleotide
aattcgcaccgcatgcagcacgagatctataacttcgtatatacctttctatacgaagttataagct

SEQ ID NO: 397 - DNA, 38 bp, Artificial Sequence
  Description of Artificial Sequence: Synthetic oligonucleotide
ataacttcgtatagcatacattatacgaagttatcgag

SEQ ID NO: 398 - DNA, 39 bp, Artificial Sequence
  Description of Artificial Sequence: Synthetic oligonucleotide
ctcgataacttcgtataatgtatgctatacgaagttatg

SEQ ID NO: 399 - DNA, 79 bp, Artificial Sequence
  Description of Artificial Sequence: Synthetic oligonucleotide
ccgggagcagggcatgctaagtgagtaataagtgagtaaataacttcgtatatacctttctatacgaagttatcgtctg

SEQ ID NO: 400 - DNA, 72 bp, Artificial Sequence
  Description of Artificial Sequence: Synthetic oligonucleotide
acgataacttcgtatagaaaggtatatacgaagttatttactcacttattactcacttagcatgccctgctc

SEQ ID NO: 401 - DNA, 59 bp, Artificial Sequence
  Description of Artificial Sequence: Synthetic oligonucleotide
ccgggaccagtggcctctggggccataacttcgtatagcatacattatacgaagttatg

SEQ ID NO: 402 - DNA, 55 bp, Artificial Sequence
  Description of Artificial Sequence: Synthetic oligonucleotide
cataacttcgtataatgtatgctatacgaagttatggccccagaggccactggtc

SEQ ID NO: 403 - DNA, 30 bp, Artificial Sequence
  Description of Artificial Sequence: Synthetic oligonucleotide
atggcgaattctcattgtcggcgcaactat

SEQ ID NO: 404 - DNA, 33 bp, Artificial Sequence
  Description of Artificial Sequence: Synthetic oligonucleotide
gataagctttcattaagactccttattacgcag

SEQ ID NO: 405 - protein, 43 aa, Artificial Sequence
  Description of Artificial Sequence: Synthetic consensus polypeptide
  MOD_RES (1)..(1): Val, Thr, Ile, Lys, Glu or Ala
  MOD_RES (3)..(3): Val or Ile
  MOD_RES (4)..(4): Asn or Asp
  MOD_RES (7)..(7): Val, Ser, Leu, Ala, Asp, Glu, Gly, Lys, Asn, Arg or Thr
  misc_feature (7)..(12): This region may encompass 4-6 residues
  MOD_RES (8)..(8): Ser, Pro, Glu, Leu, Gln or Val
  MOD_RES (9)..(9): Ser, Gly, Asn, Asp, Ile or Val
  MOD_RES (10)..(10): Pro, Ala or Ser
  MOD_RES (11)..(11): Not present, Asp, Gly, His, Asn, Arg or Ser
  MOD_RES (12)..(12): Not present, Ala, Ile, Pro, Thr or Val
  MOD_RES (14)..(14): Val, Thr, Ser, Arg, Gln, Pro, Asn, Met, Leu, Lys, Ile, Met, Gly, Glu, Asp or Ala
  misc_feature (14)..(18): This region may encompass 4-5 residues
  MOD_RES (15)..(15): Ser, Arg, Asn or His
  MOD_RES (16)..(16): Gly, Asp, Asn or Ser
  MOD_RES (17)..(17): Ser, Arg, Gln, Asn, Leu, Lys, Ile, His, Ala or Gly
  MOD_RES (18)..(18): Not present, Ile, Lys, Asn, Arg, Ser or Thr
  MOD_RES (20)..(20): Val, Gln, Leu, Lys, Ile or Glu
  MOD_RES (21)..(21): Asn or Asp
  MOD_RES (22)..(22): Thr, Ser, Leu or Ile
  MOD_RES (23)..(23): Val, Gln, Pro, Leu, Glu or Ala
  MOD_RES (25)..(25): Ser or Gly
  MOD_RES (26)..(26): Thr or Phe
  MOD_RES (27)..(27): Ser, Arg, Gln, Lys or His
  MOD_RES (29)..(29): Val, Ser, Arg, Gln, Asn, Met, Leu, Lys, Ile, His, Gly, Glu or Asp
  MOD_RES (31)..(31): Val, Pro, Leu, Ala, His, Asn, Arg, Ser or Thr
  misc_feature (31)..(42): This region may encompass 8-12 residues
  MOD_RES (32)..(32): Gln, Pro, Glu, Ala, Lys or Thr
  MOD_RES (34)..(34): Tyr or Phe
  MOD_RES (35)..(35): Thr, Ser, Ala, Glu, Lys, Leu, Met, Pro, Gln or Val
  MOD_RES (36)..(36): Gly, Leu, Pro, Gln or Arg
  MOD_RES (37)..(37): Val, Thr, Gln, Pro, Leu, Lys, Ile, Glu, Ala, Asp, Gly, Asn or Ser
  MOD_RES (38)..(38): Ser, Arg, Asn, Leu, Ile, His, Ala, Glu, Gly, Pro or Gln
  MOD_RES (39)..(39): Not present, Ala, Asp, Asn or Thr
  MOD_RES (40)..(40): Not present, Gly, Arg or Ser
  MOD_RES (41)..(41): Not present, Lys, Asn, Arg, Ser or Thr
  MOD_RES (42)..(42): Not present, Ala, Asp, Glu, Gly, Lys, Asn, Arg, Ser or Thr
XDXXECXXXXXXCXXXXXCXXXXGXXXCXCXXGXXXXXXXXXC

SEQ ID NO: 406 - DNA, 31 bp, Artificial Sequence
  Description of Artificial Sequence: Synthetic oligonucleotide
aaaaggcctcgagggcctgggtggcaatggt

SEQ ID NO: 407 - DNA, 72 bp, Artificial Sequence
  Description of Artificial Sequence: Synthetic oligonucleotide
  modified_base (25)..(25): a, c, t or g
cctgaaccaccacakhkaccgyksnbgcacggayycgrcrmacattcatyaayatctdyaccattgccaccc

SEQ ID NO: 408 - DNA, 75 bp, Artificial Sequence
  Description of Artificial Sequence: Synthetic oligonucleotide
  modified_base (16)..(16): a, c, t or g
cctgaaccaccacakntgscgyygykmhsgcacggayycgrcrmacattcatyaayatctdyaccattgccaccc

SEQ ID NO: 409 - DNA, 78 bp, Artificial Sequence
  Description of Artificial Sequence: Synthetic oligonucleotide
  modified_base (25)..(25): a, c, t or g
cctgaaccaccacakhkaccgyksnbgcaarbaybcgvahycwskbyacattcatyaayatctdyaccattgccaccc

SEQ ID NO: 410 - DNA, 81 bp, Artificial Sequence
  Description of Artificial Sequence: Synthetic oligonucleotide
  modified_base (16)..(16): a, c, t or g
cctgaaccaccacakntgscgyygykmhsgcaarbaybcgvahycwskbyacattcatyaayatctdyaccattgccaccc

SEQ ID NO: 411 - DNA, 81 bp, Artificial Sequence
  Description of Artificial Sequence: Synthetic oligonucleotide
tgaattttctgtatgaggttttgctaaacaactttcaacagtttcggccccagaggccctggagccacctgaaccaccaca

SEQ ID NO: 412 - DNA, 50 bp, Artificial Sequence
  Description of Artificial Sequence: Synthetic oligonucleotide
acggtgcctacccgtatgatgttccggattatgccccgggtggcaatggt

SEQ ID NO: 413 - DNA, 84 bp, Artificial Sequence
  Description of Artificial Sequence: Synthetic oligonucleotide
cctgaaccaccacaghktdbaccgghawagcctkscrsgcashbacakykawagcyacccdstrwatytwbaccattgccaccc

SEQ ID NO: 414 - DNA, 96 bp, Artificial Sequence
  Description of Artificial Sequence: Synthetic oligonucleotide
  modified_base (34)..(34): a, c, t or g
cctgaaccaccacakbykbtkcygkycbsabycngcdbawagcctkbgbkgcashbacakykawagcyacccdstrwatytwbaccattgccaccc

SEQ ID NO: 415 - DNA, 31 bp, Artificial Sequence
  Description of Artificial Sequence: Synthetic oligonucleotide
aaaaggccccagaggcccctgaaccaccaca

SEQ ID NO: 416 - DNA, 31 bp, Artificial Sequence; identical to SEQ ID NO: 406
  Description of Artificial Sequence: Synthetic primer

SEQ ID NO: 417 - DNA, 31 bp, Artificial Sequence; identical to SEQ ID NO: 415
  Description of Artificial Sequence: Synthetic primer

SEQ ID NO: 418 - protein, 20 aa, Artificial Sequence
  Description of Artificial Sequence: Synthetic peptide
GGGGSGGGGSGGGGSGGGGS

SEQ ID NO: 419 - protein, 45 aa, Artificial Sequence
  Description of Artificial Sequence: Synthetic polypeptide
  MOD_RES (2)..(7): Any amino acid; this region may encompass 4-6 residues
  MOD_RES (13)..(16): Any amino acid; this region may encompass 2-4 residues
  MOD_RES (39)..(44): Any amino acid; this region may encompass 4-6 residues
CXXXXXXEFRCAXXXXGRCIPSSWVCDGEDDCGDGSDEXXXXXXC

SEQ ID NO: 420 - DNA, 56 bp, Artificial Sequence
  Description of Artificial Sequence: Synthetic oligonucleotide
  modified_base (36)..(37): a, c, t or g
  modified_base (39)..(40): a, c, t or g
  modified_base (42)..(43): a, c, t or g
  modified_base (45)..(46): a, c, t or g
atatcccgggtctggaggcgtctggtggttcgtgtnnknnknnknnkgaattccga

SEQ ID NO: 421 - DNA, 59 bp, Artificial Sequence
  Description of Artificial Sequence: Synthetic oligonucleotide
  modified_base (36)..(37): a, c, t or g
  modified_base (39)..(40): a, c, t or g
  modified_base (42)..(43): a, c, t or g
  modified_base (45)..(46): a, c, t or g
  modified_base (48)..(49): a, c, t or g
atatcccgggtctggaggcgtctggtggttcgtgtnnknnknnknnknnkgaattccga

SEQ ID NO: 422 - DNA, 62 bp, Artificial Sequence
  Description of Artificial Sequence: Synthetic oligonucleotide
  modified_base (36)..(37): a, c, t or g
  modified_base (39)..(40): a, c, t or g
  modified_base (42)..(43): a, c, t or g
  modified_base (45)..(46): a, c, t or g
  modified_base (48)..(49): a, c, t or g
  modified_base (51)..(52): a, c, t or g
atatcccgggtctggaggcgtctggtggttcgtgtnnknnknnknnknnknnkgaattccga

SEQ ID NO: 423 - DNA, 56 bp, Artificial Sequence
  Description of Artificial Sequence: Synthetic oligonucleotide
  modified_base (39)..(40): a, c, t or g
  modified_base (42)..(43): a, c, t or g
  modified_base (45)..(46): a, c, t or g
atatcccgggtctggaggcgtctggtggttcgtgttatnnknnknnkgaattccga

SEQ ID NO: 424 - DNA, 59 bp, Artificial Sequence
  Description of Artificial Sequence: Synthetic oligonucleotide
  modified_base (36)..(37): a, c, t or g
  modified_base (42)..(43): a, c, t or g
  modified_base (45)..(46): a, c, t or g
  modified_base (48)..(49): a, c, t or g
atatcccgggtctggaggcgtctggtggttcgtgtnnktatnnknnknnkgaattccga

SEQ ID NO: 425 - DNA, 56 bp, Artificial Sequence
  Description of Artificial Sequence: Synthetic oligonucleotide
  modified_base (36)..(37): a, c, t or g
  modified_base (42)..(43): a, c, t or g
  modified_base (45)..(46): a, c, t or g
atatcccgggtctggaggcgtctggtggttcgtgtnnktatnnknnkgaattccga

SEQ ID NO: 426 - DNA, 56 bp, Artificial Sequence
  Description of Artificial Sequence: Synthetic oligonucleotide
  modified_base (36)..(37): a, c, t or g
  modified_base (39)..(40): a, c, t or g
  modified_base (45)..(46): a, c, t or g
atatcccgggtctggaggcgtctggtggttcgtgtnnknnktatnnkgaattccga

SEQ ID NO: 427 - DNA, 56 bp, Artificial Sequence
  Description of Artificial Sequence: Synthetic oligonucleotide
  modified_base (36)..(37): a, c, t or g
  modified_base (39)..(40): a, c, t or g
  modified_base (42)..(43): a, c, t or g
atatcccgggtctggaggcgtctggtggttcgtgtnnknnknnktatgaattccga

SEQ ID NO: 428 - DNA, 59 bp, Artificial Sequence
  Description of Artificial Sequence: Synthetic oligonucleotide
  modified_base (36)..(37): a, c, t or g
  modified_base (39)..(40): a, c, t or g
  modified_base (42)..(43): a, c, t or g
  modified_base (48)..(49): a, c, t or g
atatcccgggtctggaggcgtctggtggttcgtgtnnknnknnktatnnkgaattccga

SEQ ID NO: 429 - DNA, 49 bp, Artificial Sequence
  Description of Artificial Sequence: Synthetic oligonucleotide
  modified_base (30)..(31): a, c, t or g
  modified_base (33)..(34): a, c, t or g
atacccaagaagacggtatacatcgtccmnnmnntgcacatcggaattc

SEQ ID NO: 430 - DNA, 52 bp, Artificial Sequence
  Description of Artificial Sequence: Synthetic oligonucleotide
  modified_base (30)..(31): a, c, t or g
  modified_base (33)..(34): a, c, t or g
  modified_base (36)..(37): a, c, t or g
atacccaagaagacggtatacatcgtccmnnmnnmnntgcacatcggaattc

SEQ ID NO: 431 - DNA, 55 bp, Artificial Sequence
  Description of Artificial Sequence: Synthetic oligonucleotide
  modified_base (30)..(31): a, c, t or g
  modified_base (33)..(34): a, c, t or g
  modified_base (36)..(37): a, c, t or g
  modified_base (39)..(40): a, c, t or g
atacccaagaagacggtatacatcgtccmnnmnnmnnmnntgcacatcggaattc

SEQ ID NO: 432 - DNA, 52 bp, Artificial Sequence
  Description of Artificial Sequence: Synthetic oligonucleotide
  modified_base (33)..(34): a, c, t or g
  modified_base (36)..(37): a, c, t or g
atacccaagaagacggtatacatcgtccatamnnmnntgcacatcggaattc

SEQ ID NO: 433 - DNA, 55 bp, Artificial Sequence
  Description of Artificial Sequence: Synthetic oligonucleotide
  modified_base (30)..(31): a, c, t or g
  modified_base (36)..(37): a, c, t or g
  modified_base (39)..(40): a, c, t or g
atacccaagaagacggtatacatcgtccmnnatamnnmnntgcacatcggaattc

SEQ ID NO: 434 - DNA, 52 bp, Artificial Sequence
  Description of Artificial Sequence: Synthetic oligonucleotide
  modified_base (30)..(31): a, c, t or g
  modified_base (36)..(37): a, c, t or g
atacccaagaagacggtatacatcgtccmnnatamnntgcacatcggaattc

SEQ ID NO: 435 - DNA, 52 bp, Artificial Sequence
  Description of Artificial Sequence: Synthetic oligonucleotide
  modified_base (30)..(31): a, c, t or g
  modified_base (33)..(34): a, c, t or g
atacccaagaagacggtatacatcgtccmnnmnnatatgcacatcggaattc

SEQ ID NO: 436 - DNA, 55 bp, Artificial Sequence
  Description of Artificial Sequence: Synthetic oligonucleotide
  modified_base (30)..(31): a, c, t or g
  modified_base (33)..(34): a, c, t or g
  modified_base (39)..(40): a, c, t or g
atacccaagaagacggtatacatcgtccmnnmnnatamnntgcacatcggaattc

SEQ ID NO: 437 - DNA, 55 bp, Artificial Sequence
  Description of Artificial Sequence: Synthetic oligonucleotide
accgtcttcttgggtatgtgacggggaggacgattgtggtgacggatctgacgag

SEQ ID NO: 438 - DNA, 66 bp, Artificial Sequence
  Description of Artificial Sequence: Synthetic oligonucleotide
  modified_base (42)..(43): a, c, t or g
  modified_base (45)..(46): a, c, t or g
  modified_base (48)..(49): a, c, t or g
  modified_base (51)..(52): a, c, t or g
atatggccccagaggcctgcaatgatccaccgcccccacamnnmnnmnnmnnctcgtcagatccgt

SEQ ID NO: 439 - DNA, 69 bp, Artificial Sequence
  Description of Artificial Sequence: Synthetic oligonucleotide
  modified_base (42)..(43): a, c, t or g
  modified_base (45)..(46): a, c, t or g
  modified_base (48)..(49): a, c, t or g
  modified_base (51)..(52): a, c, t or g
  modified_base (54)..(55): a, c, t or g
atatggccccagaggcctgcaatgatccaccgcccccacamnnmnnmnnmnnmnnctcgtcagatccgt

SEQ ID NO: 440 - DNA, 72 bp, Artificial Sequence
  Description of Artificial Sequence: Synthetic oligonucleotide
  modified_base (42)..(43): a, c, t or g
  modified_base (45)..(46): a, c, t or g
  modified_base (48)..(49): a, c, t or g
  modified_base (51)..(52): a, c, t or g
  modified_base (54)..(55): a, c, t or g
  modified_base (57)..(58): a, c, t or g
atatggccccagaggcctgcaatgatccaccgcccccacamnnmnnmnnmnnmnnmnnctcgtcagatccgt

SEQ ID NO: 441 - DNA, 66 bp, Artificial Sequence
  Description of Artificial Sequence: Synthetic oligonucleotide
  modified_base (45)..(46): a, c, t or g
  modified_base (48)..(49): a, c, t or g
  modified_base (51)..(52): a, c, t or g
atatggccccagaggcctgcaatgatccaccgcccccacaatamnnmnnmnnctcgtcagatccgt

SEQ ID NO: 442 - DNA, 69 bp, Artificial Sequence
  Description of Artificial Sequence: Synthetic oligonucleotide
  modified_base (42)..(43): a, c, t or g
  modified_base (48)..(49): a, c, t or g
  modified_base (51)..(52): a, c, t or g
  modified_base (54)..(55): a, c, t or g
atatggccccagaggcctgcaatgatccaccgcccccacamnnatamnnmnnmnnctcgtcagatccgt

SEQ ID NO: 443 - DNA, 66 bp, Artificial Sequence
  Description of Artificial Sequence: Synthetic oligonucleotide
  modified_base (42)..(43): a, c, t or g
  modified_base (48)..(49): a, c, t or g
  modified_base (51)..(52): a, c, t or g
atatggccccagaggcctgcaatgatccaccgcccccacamnnatamnnmnnctcgtcagatccgt

SEQ ID NO: 444 - DNA, 66 bp, Artificial Sequence
  Description of Artificial Sequence: Synthetic oligonucleotide
  modified_base (42)..(43): a, c, t or g
  modified_base (45)..(46): a, c, t or g
  modified_base (51)..(52): a, c, t or g
atatggccccagaggcctgcaatgatccaccgcccccacamnnmnnatamnnctcgtcagatccgt

SEQ ID NO: 445 - DNA, 66 bp, Artificial Sequence
  Description of Artificial Sequence: Synthetic oligonucleotide
  modified_base (42)..(43): a, c, t or g
  modified_base (45)..(46): a, c, t or g
  modified_base (48)..(49): a, c, t or g
atatggccccagaggcctgcaatgatccaccgcccccacamnnmnnmnnatactcgtcagatccgt

SEQ ID NO: 446 - DNA, 69 bp, Artificial Sequence
  Description of Artificial Sequence: Synthetic oligonucleotide
  modified_base (42)..(43): a, c, t or g
  modified_base (45)..(46): a, c, t or g
  modified_base (48)..(49): a, c, t or g
  modified_base (54)..(55): a, c, t or g
atatggccccagaggcctgcaatgatccaccgcccccacamnnmnnmnnatamnnctcgtcagatccgt

SEQ ID NO: 447 - protein, 35 aa, Artificial Sequence
  Description of Artificial Sequence: Synthetic polypeptide
  MOD_RES (2)..(5): Any amino acid
  MOD_RES (7)..(7): Any amino acid
  MOD_RES (9)..(12): Any amino acid
  MOD_RES (15)..(17): Any amino acid
  MOD_RES (19)..(19): Any amino acid
  MOD_RES (23)..(24): Any amino acid
  MOD_RES (27)..(27): Any amino acid
  MOD_RES (29)..(29): Any amino acid
  MOD_RES (33)..(34): Any amino acid
CXXXXFXCXXXXCIXXXWXCDGXXDCXDXSDEXXC

SEQ ID NO: 448 - protein, 47 aa, Artificial Sequence
  Description of Artificial Sequence: Synthetic polypeptide
CGEGLFTCGSTNICISSAWVCDGVDDCEDNSDENNCSAPASEPPGSL

SEQ ID NO: 449 - protein, 47 aa, Artificial Sequence
  Description of Artificial Sequence: Synthetic polypeptide
CGEGLFTCRSTNICISEAWICDGVDDCEDNSDEKNCSAPASEPPGSL

SEQ ID NO: 450 - protein, 47 aa, Artificial Sequence
  Description of Artificial Sequence: Synthetic polypeptide
CGAGLFTCRSAKICISHAWVCDGIDDCEDNSDENNCSAPASEPPGSL

SEQ ID NO: 451 - DNA, 36 bp, Artificial Sequence
  Description of Artificial Sequence: Synthetic primer
ttatgccccgggtctggaggcgtctggtggttcgtg

SEQ ID NO: 452 - DNA, 47 bp, Artificial Sequence
  Description of Artificial Sequence: Synthetic primer
aaaagggccccagaggccttctgcaatgacagggaacccggcggttc

SEQ ID NO: 453 - DNA, 87 bp, Artificial Sequence
  Description of Artificial Sequence: Synthetic primer
gaggcgtctggtggttcgtgtggggcgggcctgttcacgtgccgcagtaccaaaatatgcatttcacaggcctgggtttgcgacggc

SEQ ID NO: 454 - DNA, 82 bp, Artificial Sequence
  Description of Artificial Sequence: Synthetic primer
acagggaacccggcggttcagatgctggcgcgctacagtttttttcatccgagttgtcctcacaatcatcaacgccgtcgca

SEQ ID NO: 455 - DNA, 44 bp, Artificial Sequence
  Description of Artificial Sequence: Synthetic primer
aaaagggccccagaggccttctgcaatgacactttgtgaaattc

SEQ ID NO: 456 - DNA, 87 bp, Artificial Sequence
  Description of Artificial Sequence: Synthetic primer
gaggcgtctggtggttcgtgtgggtcgaaccagttcacgtgccggagtaccaacatatgcatttcacaggcctgggtttgcgacggc

SEQ ID NO: 457 - DNA, 81 bp, Artificial Sequence
  Description of Artificial Sequence: Synthetic primer
caatgacactttgtgaaattccggatcctggctacagcctgtttcatccgagtcgtcctcacaatcatcaacgccgtcgca

SEQ ID NO: 458 - DNA, 43 bp, Artificial Sequence
  Description of Artificial Sequence: Synthetic primer
aaaagggccccagaggccttctgcaatgacgtacgctctggac

SEQ ID NO: 459 - DNA, 84 bp, Artificial Sequence
  Description of Artificial Sequence: Synthetic primer
gaggcgtctggtggttcgtgtcggctgaacgagttcccgtgtggcagcggcagctgcatttcactgcactgggtttgcgacagc

SEQ ID NO: 460 - DNA, 66 bp, Artificial Sequence
  Description of Artificial Sequence: Synthetic primer
caatgacgtacgctctggacagtctgtttcatccgagtcgtcccgacaatccggaacgctgtcgca

SEQ ID NO: 461 - DNA, 9 bp, Artificial Sequence
  Description of Artificial Sequence: Synthetic oligonucleotide
tgcgacggc

SEQ ID NO: 462 - protein, 48 aa, Artificial Sequence
  Description of Artificial Sequence: Synthetic polypeptide
CLPDEFQCGSGRCIPQTWVCDGLNDCGDGSDESPAHCSQDPEFHKVSL

SEQ ID NO: 463 - protein, 41 aa, Artificial Sequence
  Description of Artificial Sequence: Synthetic polypeptide
CRSSQFQCNNGHCLSPTWVCDGYDDCEDGSDEANCPTHTSL

SEQ ID NO: 464 - protein, 47 aa, Artificial Sequence
  Description of Artificial Sequence: Synthetic polypeptide
CGAGLFTCRNSKICISQAWVCDGVDDCDDNSDEKYCSAPASEPPGSL

SEQ ID NO: 465 - protein, 46 aa, Artificial Sequence
  Description of Artificial Sequence: Synthetic polypeptide
CLSDEFQCRSGRCIPQRWVCDGLNDCGDGSDEWPAQCSQDPEFHKV

SEQ ID NO: 466 - DNA, 39 bp, Artificial Sequence
  Description of Artificial Sequence: Synthetic primer
ggattatgccccgggtctggaggcgtctggtggttcgtg

SEQ ID NO: 467 - DNA, 61 bp, Artificial Sequence
  Description of Artificial Sequence: Synthetic primer
tgctcgagggccccagaggccttctgcaatgacactttgtgaaattccggatcctggctac

SEQ ID NO: 468 - DNA, 45 bp, Artificial Sequence
  Description of Artificial Sequence: Synthetic primer
gctcgagggccccagaggccttctgcaatgacgtatgcgttggac

SEQ ID NO: 469 - DNA, 65 bp, Artificial Sequence
  Description of Artificial Sequence: Synthetic primer
ctcgagggccccagaggccttctgcaatgacagggaacccggcggttcagatgctggcgcgctac

SEQ ID NO: 470 - DNA, 77 bp, Artificial Sequence
  Description of Artificial Sequence: Synthetic primer
ctcgagggccccagaggccttctgcaatgacgtgctcggacctggggtgctaaacggcagaatatgagaatcaccac

SEQ ID NO: 471 - DNA, 84 bp, Artificial Sequence
  Description of Artificial Sequence: Synthetic primer
gaggcgtctggtggttcgtgtctgccggacgagttccagtgcgggtcgggacggtgcattccacagacgtgggtttgcgacggc

SEQ ID NO: 472 - DNA, 75 bp, Artificial Sequence
  Description of Artificial Sequence: Synthetic primer
gtgaaattccggatcctggctacagtgtgccggcgattcatccgatccgtccccacaatcatttaggccgtcgca

SEQ ID NO: 473 - DNA, 84 bp, Artificial Sequence
  Description of Artificial Sequence: Synthetic primer
gaggcgtctggtggttcgtgtcggtcgagccagttccagtgcaacaacgggcactgcctttcgccgacctgggtttgcgacggc

SEQ ID NO: 474 - DNA, 69 bp, Artificial Sequence
  Description of Artificial Sequence: Synthetic primer
ctgcaatgacgtatgcgttggacagtttgcttcatccgacccgtcctcacaatcatcatagccgtcgca

SEQ ID NO: 475 - DNA, 84 bp, Artificial Sequence
  Description of Artificial Sequence: Synthetic primer
gaggcgtctggtggttcgtgtcagccggacgagttcacgtgcagctcggggcggtgcattccacagccctggctttgcgacggc

SEQ ID NO: 476 - DNA, 73 bp, Artificial Sequence
  Description of Artificial Sequence: Synthetic primer
gttcagatgctggcgcgctacagtgtgccggcggttcatccgatccgtccccacaatcattaaggccgtcgca

SEQ ID NO: 477 - DNA, 87 bp, Artificial Sequence
  Description of Artificial Sequence: Synthetic primer
gaggcgtctggtggttcgtgtcactcgttcaaccaatttgaatgccggaacgggcaatgcattccactgcacctggtttgcgacggc

SEQ ID NO: 478 - DNA, 70 bp, Artificial Sequence
  Description of Artificial Sequence: Synthetic primer
acggcagaatatgagaatcaccacagtctgtttcatccgagttgtccccacaatccggaacgccgtcgca

SEQ ID NO: 479 - protein, 45 aa, Artificial Sequence
  Description of Artificial Sequence: Synthetic polypeptide
CGTNMFTCQRTNICISDAWVCDGVDDCEDYSDETACSQDPEFHKV

SEQ ID NO: 480 - protein, 40 aa, Artificial Sequence
  Description of Artificial Sequence: Synthetic polypeptide
CAANEFRCSNGRCIPEPWLCDGLNDCGDGSDEPPHCAPPT

SEQ ID NO: 481 - protein, 47 aa, Artificial Sequence
  Description of Artificial Sequence: Synthetic polypeptide
CQSNEFRCRSGRCIPQHWLCDGLNDCGDGSDESQQCSAPASEPPGSL

SEQ ID NO: 482 - protein, 45 aa, Artificial Sequence
  Description of Artificial Sequence: Synthetic polypeptide
CGANLFTCRSTNICISPTWVCDGVDDCDDNSDEIGCSQDLEFHKV

SEQ ID NO: 483 - protein, 48 aa, Artificial Sequence
  Description of Artificial Sequence: Synthetic polypeptide
CPPSQFTCGNGRCVSLGWVCDGLNDCGDGSDESPALCSAPASEPPGSL

SEQ ID NO: 484 - protein, 52 aa, Artificial Sequence
  Description of Artificial Sequence: Synthetic polypeptide
CAPSQFQCHDNNICLLEGLLCDGEDDCADGSDEAPVCGDSHILPFSTPGPST

SEQ ID NO: 485 - protein, 45 aa, Artificial Sequence
  Description of Artificial Sequence: Synthetic polypeptide
CGPNLFTCRSTNICISRAWVCDGVDDCDDESDEQGCSQDPEFHKV

SEQ ID NO: 486 - DNA, 22 bp, Artificial Sequence
  Description of Artificial Sequence: Synthetic oligonucleotide
acccgtatgatgttccggatta

SEQ ID NO: 487 - DNA, 31 bp, Artificial Sequence
  Description of Artificial Sequence: Synthetic oligonucleotide
gatgtattcggccccagaggcctgcaatgac

SEQ ID NO: 488 - DNA, 20 bp, Artificial Sequence
  Description of Artificial Sequence: Synthetic oligonucleotide
gaaattcacctcgaaagcaa

SEQ ID NO: 489 - DNA, 18 bp, Artificial Sequence
  Description of Artificial Sequence: Synthetic oligonucleotide
atgggttcctattgggct

SEQ ID NO: 490 - DNA, 40 bp, Artificial Sequence
  Description of Artificial Sequence: Synthetic primer
atcatctggccggtccggcctacccgtatgatgttccgga

SEQ ID NO: 491 - DNA, 29 bp, Artificial Sequence
  Description of Artificial Sequence: Synthetic primer
aaaaggccccagaggccttctgcaatgac

SEQ ID NO: 492 - protein, 8 aa, Artificial Sequence
  Description of Artificial Sequence: Synthetic 8xHis tag
HHHHHHHH

SEQ ID NO: 493 - protein, 50 aa, Artificial Sequence
  Description of Artificial Sequence: Synthetic polypeptide
CASGQFQCSNGNCVPQHWVCDGDNDCEDNSDEEDCGDSHILPFSTPGPST

SEQ ID NO: 494 - protein, 51 aa, Artificial Sequence
  Description of Artificial Sequence: Synthetic polypeptide
CGSSEFQCRNSRRCIPPAWVCDGDNDCGDSSDEKSCGDSHILPFSTPGPST

SEQ ID NO: 495 - protein, 50 aa, Artificial Sequence
  Description of Artificial Sequence: Synthetic polypeptide
CVSGQFQCGNGNCIPRPWRCDGDNDCGDSSDETGCGDSHILPFSTPGPST

SEQ ID NO: 496 - protein, 43 aa, Artificial Sequence
  Description of Artificial Sequence: Synthetic polypeptide
CVPGQFQCNNGNCIPVTWLCDGDNDCGDSSDEAPAHCETSGPT

SEQ ID NO: 497 - protein, 39 aa, Artificial Sequence
  Description of Artificial Sequence: Synthetic polypeptide
CVSGQFQCGNGNCIPQAWLCDGDNDCGDSSDEKDCTTRT

SEQ ID NO: 498 - protein, 47 aa, Artificial Sequence
  Description of Artificial Sequence: Synthetic polypeptide
CRSRQFQCKGSSTCIPVQWVCDGDNDCGDSSDEAGCSAPASEPPGSL

SEQ ID NO: 499 - protein, 40 aa, Artificial Sequence
  Description of Artificial Sequence: Synthetic polypeptide
CGAGQFQCRSTNICVSLAWRCDGEDDCEDNSDETSCATHT

SEQ ID NO: 500 - protein, 51 aa, Artificial Sequence
  Description of Artificial Sequence: Synthetic polypeptide
CGAGQFTCRSTKICISQAWVCDGVDDCEDNSDEAGCGDSHILPFSTPGPST

SEQ ID NO: 501 - protein, 51 aa, Artificial Sequence
  Description of Artificial Sequence: Synthetic polypeptide
CGAGQFTCRSTNICLPLQWVCDGVDDCEDNSDEAGCGDSHILPFSTPGPST

SEQ ID NO: 502 - protein, 51 aa, Artificial Sequence
  Description of Artificial Sequence: Synthetic polypeptide
CGANQFTCHNTNICISLTWVCDGVDDCEDNSDEAGCGDSHILPFSTPGPST

SEQ ID NO: 503 - protein, 51 aa, Artificial Sequence
  Description of Artificial Sequence: Synthetic polypeptide
CGSSQFTCHNTNICLPRARVCDGVDDCEDNSDEAGCGDSHILPFSTPGPST

SEQ ID NO: 504 - protein, 51 aa, Artificial Sequence
  Description of Artificial Sequence: Synthetic polypeptide
CGSSQFTCHNTNICLPRAWVCDGVDDCEDNSDEAGCGDSHILPFSTPGPST

SEQ ID NO: 505 - protein, 51 aa, Artificial Sequence
  Description of Artificial Sequence: Synthetic polypeptide
CGANQFTCHNTNICISLTWVCDGVDDCEDGSDESPDHCGRPGPGATSAPAA

SEQ ID NO: 506 - protein, 49 aa, Artificial Sequence
  Description of Artificial Sequence: Synthetic polypeptide
CGPIQFTCRNTNICLSVHWVCDGEDDCEDGSDEEGCGRPGPGATSAPAA

SEQ ID NO: 507 - protein, 49 aa, Artificial Sequence
  Description of Artificial Sequence: Synthetic polypeptide
CGPNQFTCRSTNICLSQTWVCDGVDDCEDGSDETNCGRPGPGATSAPAA

SEQ ID NO: 508 - protein, 42 aa, Artificial Sequence
  Description of Artificial Sequence: Synthetic polypeptide
CGPSQFTCRNTNICISLRWRCDGVDDCEDNSDEEGCGTTGPT

SEQ ID NO: 509 - protein, 46 aa, Artificial Sequence
  Description of Artificial Sequence: Synthetic polypeptide
CMTDEFRCRSGRCIPQTWVCDGLNDCGDGSDEWPAQCSQDPEFHKV

SEQ ID NO: 510 - protein, 44 aa, Artificial Sequence
  Description of Artificial Sequence: Synthetic polypeptide
CAANEFTCRSGRCLSRPWLCDGENDCGDGSDEADCSQDPEFHKV

SEQ ID NO: 511 - protein, 45 aa, Artificial Sequence
  Description of Artificial Sequence: Synthetic polypeptide
CQSNEFQCRSTGRCISVAWVCDGEDDCRDSSDEADCSQDPEFHKV

SEQ ID NO: 512 - protein, 44 aa, Artificial Sequence
  Description of Artificial Sequence: Synthetic polypeptide
CPSNQFPCRSTGICIPLAWVCDGLNDCGDGSDESPATCKAPVPT

SEQ ID NO: 513 - protein, 49 aa, Artificial Sequence
  Description of Artificial Sequence: Synthetic polypeptide
CASGQFTCRSTNICLSLAWLCDGDDDCEDNSDESPAICSAPASEPPGSL

SEQ ID NO: 514 - protein, 49 aa, Artificial Sequence
  Description of Artificial Sequence: Synthetic polypeptide
CPSNEFQCQNSGRCIPRRWLCDGEDDCGDNSDEASCGRPGPGATSAPAA

SEQ ID NO: 515 - protein, 47 aa, Artificial Sequence
  Description of Artificial Sequence: Synthetic polypeptide
CGAGQFQCRSTNICISLKWVCDGVDDCEDNSDETSCSAPASEPPGSL

SEQ ID NO: 516 - protein, 47 aa, Artificial Sequence
  Description of Artificial Sequence: Synthetic polypeptide
CGAGQFTCNSTNICISPRWVCDGVNDCEDNSDEKNCSAPASEPPGSL

SEQ ID NO: 517 - protein, 47 aa, Artificial Sequence
  Description of Artificial Sequence: Synthetic polypeptide
CGARQFPCRGSRICISQPWVCDGDNDCEDNSDEKNCSAPASEPPGSL

SEQ ID NO: 518 - protein, 39 aa, Artificial Sequence
  Description of Artificial Sequence: Synthetic polypeptide
CQSSEFQCSNGSCIPRPLVCDGENDCGDSSDETDCKEPT

SEQ ID NO: 519 - protein, 47 aa, Artificial Sequence
  Description of Artificial Sequence: Synthetic polypeptide
CGSSQFTCHNTNICLPQAWVCDGVDDCEDNSDEKNCSAPASEPPGSL

SEQ ID NO: 520 - protein, 47 aa, Artificial Sequence
  Description of Artificial Sequence: Synthetic polypeptide
CGSSQFTCHNTNICLPRAWVCDGVDDCEDNSDEKNCSAPASEPPGSL

SEQ ID NO: 521 - protein, 47 aa, Artificial Sequence
  Description of Artificial Sequence: Synthetic polypeptide
CGPGQFTCQDTEICISQAWVCDGVDDCEDNSDEKNCSAPASEPPGSL

SEQ ID NO: 522 - protein, 47 aa, Artificial Sequence
  Description of Artificial Sequence: Synthetic polypeptide
CGAGQFTCRSTKICISQAWVCDGVDDCEDNSDETSCSAPASEPPGSL

SEQ ID NO: 523 - protein, 43 aa, Artificial Sequence
  Description of Artificial Sequence: Synthetic polypeptide
CRPGEFRCRSTNTCISQSLRCDGEPDCRDGSDEPEDCESVAHT

SEQ ID NO: 524 - protein, 47 aa, Artificial Sequence
  Description of Artificial Sequence: Synthetic polypeptide
CGAGQFTCRSTKICISQAWVCDGVDDCEDNSDEKNCSAPASELPGSL

SEQ ID NO: 525 - protein, 47 aa, Artificial Sequence
  Description of Artificial Sequence: Synthetic polypeptide
CGTGQFTCRSTKICISQAWVCDGVDDCEDNSDEKNCSAPASEPPGSL

SEQ ID NO: 526 - protein, 46 aa, Artificial Sequence
  Description of Artificial Sequence: Synthetic polypeptide
CLPDEFQCRSGRCIPQTWVCDGLNDCGDGSDESPAQCSQDPEFHKV

SEQ ID NO: 527 - protein, 42 aa, Artificial Sequence
  Description of Artificial Sequence: Synthetic polypeptide
CRSSEFPCHGYSTCISLSLLCDGVDDCADNSDEESCRAAGHT

SEQ ID NO: 528 - protein, 42 aa, Artificial Sequence
  Description of Artificial Sequence: Synthetic polypeptide
CHHHHFHCLSGECINTWRCDGGPDCKDKSDEENCPTKRPEEV

SEQ ID NO: 529 - protein, 43 aa, Artificial Sequence
  Description of Artificial Sequence: Synthetic polypeptide
CSRAHFHCLSGECIHHHWRCDGGPDCKDKSDEENCPTKRPEEV

SEQ ID NO: 530 - protein, 39 aa, Artificial Sequence
  Description of Artificial Sequence: Synthetic polypeptide
CSAFEFHCLSGECIHSSWRCDMDWDCKDQPDQLWCALET

SEQ ID NO: 531 - protein, 39 aa, Artificial Sequence
  Description of Artificial Sequence: Synthetic polypeptide
CSAFEFHCLSGECIHSSWRCDWYWDCKDYWDPLVCELEA

SEQ ID NO: 532 - protein, 39 aa, Artificial Sequence
  Description of Artificial Sequence: Synthetic polypeptide
CSAFEFHCLSGECIHSSWRCDWDDDCKDWQDYVMCALEA

SEQ ID NO: 533 - protein, 39 aa, Artificial Sequence
  Description of Artificial Sequence: Synthetic polypeptide
CSAFEFHCLSGECIHSSWRCDWDLDCKDHPDEVMCALEA

SEQ ID NO: 534 - protein, 39 aa, Artificial Sequence
  Description of Artificial Sequence: Synthetic polypeptide
CVPNQFPRGNGSCIPLPLVCDGVDDCLDDSDEKNCTPPT

SEQ ID NO: 535 - protein, 39 aa, Artificial Sequence
  Description of Artificial Sequence: Synthetic polypeptide
CVPNQFQCGSGRCLPHPLGCDGVDDCLDGSDEASCAPPT

SEQ ID NO: 536 - protein, 40 aa, Artificial Sequence
  Description of Artificial Sequence: Synthetic polypeptide
CVSDEFPCRDNNICVLLHLLCDGVDDCLDSSDETGCAKPT

SEQ ID NO: 537 - protein, 51 aa, Artificial Sequence
  Description of Artificial Sequence: Synthetic polypeptide
CRSSQFPCQDSNICVLETLLCDGVDDCVDDSDEEDCGDSHILPFSTPGPST

SEQ ID NO: 538 - protein, 39 aa, Artificial Sequence
  Description of Artificial Sequence: Synthetic polypeptide
CRSNQFRCNSGHCLPRPWLCDGVDDCQDDSDETDCPART

SEQ ID NO: 539 - protein, 41 aa, Artificial Sequence
  Description of Artificial Sequence: Synthetic polypeptide
CRPGQFWCNSGRCLPPAWRCDGVNDCGDDSDEPLALCEKHT

SEQ ID NO: 540 - protein, 48 aa, Artificial Sequence
  Description of Artificial Sequence: Synthetic polypeptide
CLPNQFRCGNGHCLSRTWVCDGVPDCEDNSDESLAHCSAPASEPPGSL

SEQ ID NO: 541 - protein, 48 aa, Artificial Sequence
  Description of Artificial Sequence: Synthetic polypeptide
CPAGQFQCGNGQCLSLTWLCDGVPDCGDNSDESSALCSAPASEPPGSL

SEQ ID NO: 542 - protein, 48 aa, Artificial Sequence
  Description of Artificial Sequence: Synthetic polypeptide
CRPNEFPCNNGRCLSQTWVCDGLNDCGDGSDESPELCSAPASEPPGSL

SEQ ID NO: 543 - protein, 48 aa, Artificial Sequence
  Description of Artificial Sequence: Synthetic polypeptide
CQPDEFTCRSGRCIPQPWLCDGLNDCGDGSDEPPGHCTAPASEPPGSL

SEQ ID NO: 544 - protein, 43 aa, Artificial Sequence
  Description of Artificial Sequence: Synthetic polypeptide
CPPNQFRCGNGHCLSVSWLCDGVPDCGDNSDEALAICRASEHT

SEQ ID NO: 545 - protein, 52 aa, Artificial Sequence
  Description of Artificial Sequence: Synthetic polypeptide
CRANEFRCNSGRCLSQTWVCDGVDDCEDGSDESLAICGDSHILPFSTPGPST

SEQ ID NO: 546 - protein, 52 aa, Artificial Sequence
  Description of Artificial Sequence: Synthetic polypeptide
CRANQFTCNNGHCLSRTWLCDGVPDCEDNSDESLAIRGDSHILPFSTPGPST

SEQ ID NO: 547 - protein, 52 aa, Artificial Sequence
  Description of Artificial Sequence: Synthetic polypeptide
CRANQFTCNNGHCLSRTWLCDGVPDCEDNSDESLAICGDSHILPFSTPGPST

SEQ ID NO: 548 - protein, 52 aa, Artificial Sequence
  Description of Artificial Sequence: Synthetic polypeptide
CLPGQFRCNSGHCLSQTWVCDGYNDCGDGSDEPLATCGDSHILPFSTPGPST

SEQ ID NO: 549 - protein, 51 aa, Artificial Sequence
  Description of Artificial Sequence: Synthetic polypeptide
CKPTNEFRCSNGHCISRALLCDGENDCEDNSDETSCGDSHILPFSTPGPST

SEQ ID NO: 550 - protein, 51 aa, Artificial Sequence
  Description of Artificial Sequence: Synthetic polypeptide
CASSEFQCRSTRTCVPLGWVCDGDNDCPDNSDETDCGDSHILPFSTPGPST

SEQ ID NO: 551 - protein, 51 aa, Artificial Sequence
  Description of Artificial Sequence: Synthetic polypeptide
CQATAQFQCDNGHCLSANWRCDGVDDCGDNSDEEDCGDSHILPFSTPGPST

SEQ ID NO: 552 - protein, 53 aa, Artificial Sequence
  Description of Artificial Sequence: Synthetic polypeptide
CKSIAQFECSNGHCLSRTWLCDGVDDCGDNSDEALATCGDSHILPFSTPGPST

SEQ ID NO: 553 - protein, 52 aa, Artificial Sequence
  Description of Artificial Sequence: Synthetic polypeptide
CRPSEFQCGNGSCLSATWLCDGVPDCGDGSDESPETCGDSHILPFSTPGPST

SEQ ID NO: 554 - protein, 50 aa, Artificial Sequence
  Description of Artificial Sequence: Synthetic polypeptide
CRPNEFQCGNGHCLSANWLCDGVDDCGDDSDETSCGDSHILPFSTPGPST

SEQ ID NO: 555 - protein, 43 aa, Artificial Sequence
  Description of Artificial Sequence: Synthetic polypeptide
CPSSQFQCKNGHCLSRTWLCDGVDDCQDGSDESPAICTASGHT

SEQ ID NO: 556 - protein, 52 aa, Artificial Sequence
  Description of Artificial Sequence: Synthetic polypeptide
CPSSQFQCKNGHCLSRTWLCDGVDDCQDGSDESPATCGDSHILPFSTPGPST

SEQ ID NO: 557 - protein, 39 aa, Artificial Sequence
  Description of Artificial Sequence: Synthetic polypeptide
CRSSQFQCNNGHCLSPTWVCDGYDDCEDGSDEANCPTHT

SEQ ID NO: 558 - protein, 39 aa, Artificial Sequence
  Description of Artificial Sequence: Synthetic polypeptide
CRSSEFQCNNGHCLSATWVCDGYDDCEDGSDEANCPTHT

SEQ ID NO: 559 - protein, 39 aa, Artificial Sequence
  Description of Artificial Sequence: Synthetic polypeptide
CPANQFRCNNGHCLSRTWVCDGYDDCEDGSDEANCPTHT

SEQ ID NO: 560 - protein, 41 aa, Artificial Sequence
  Description of Artificial Sequence: Synthetic polypeptide
CPANQFRCNNGHCLSGTWLCDGVDDCGDNSDESSATCEPHT

SEQ ID NO: 561 - protein, 41 aa, Artificial Sequence
  Description of Artificial Sequence: Synthetic polypeptide
CRSSEFQCGNGHCLSRTWLCDGVNDCGDDSDEKNCAGAAPT

SEQ ID NO: 562 - protein, 41 aa, Artificial Sequence
  Description of Artificial Sequence: Synthetic polypeptide
CRSSEFKCKNGHCLSATWVCDGYVDCGDDSDEEDCATSGHT

SEQ ID NO: 563 - protein, 46 aa, Artificial Sequence
  Description of Artificial Sequence: Synthetic polypeptide
CPPDEFQCRSGWCIPQKWVCDGLNDCGDGSDESPALCSQDPEFHKV

SEQ ID NO: 564 - protein, 39 aa, Artificial Sequence
  Description of Artificial Sequence: Synthetic polypeptide
CLPSQFQCNNGHCLSRTWVCDGYDDCGDWSDESNCPTHT

SEQ ID NO: 565 - protein, 39 aa, Artificial Sequence
  Description of Artificial Sequence: Synthetic polypeptide
CRSSEFQCNNGHCLSATWVCDGYDDCEDGSDESNCPTHT

SEQ ID NO: 566 - protein, 39 aa, Artificial Sequence
  Description of Artificial Sequence: Synthetic polypeptide
CRSSEFQCNTGHCLSRTWVCDGYDDCGDGSDEANCPTHT

SEQ ID NO: 567 - protein, 39 aa, Artificial Sequence
  Description of Artificial Sequence: Synthetic polypeptide
CWSSAFQCNNGHCLSPSWVCDGYDDCGDGSDEANCPTHT

SEQ ID NO: 568 - protein, 39 aa, Artificial Sequence
  Description of Artificial Sequence: Synthetic polypeptide
CLSGQFQCSNGHCLSRTWVCDGYVDCEDGSDEAKCPTHT

SEQ ID NO: 569 - protein, 39 aa, Artificial Sequence
  Description of Artificial Sequence: Synthetic polypeptide
CRSGQFQCNNGHCLSATWVCDGYDDCDDGSDEANCPTHT

SEQ ID NO: 570 - protein, 39 aa, Artificial Sequence
  Description of Artificial Sequence: Synthetic polypeptide
CRSGQFQCNNGHCLSQTWVCDGYDDCDDGSDEANCPTHT

SEQ ID NO: 571 - protein, 39 aa, Artificial Sequence
  Description of Artificial Sequence: Synthetic polypeptide
CRSGQFQCNNGHCLSRTWVCDGYDDCDDGSDEANCPTHT

SEQ ID NO: 572 - protein, 39 aa, Artificial Sequence
  Description of Artificial Sequence: Synthetic polypeptide
CRSGQFQCNNGHCLSSTWVCDGFDDCEDGSDEANCPTHT

SEQ ID NO: 573 - protein, 39 aa, Artificial Sequence
  Description of Artificial Sequence: Synthetic polypeptide
CLSSSFQCNNGHCLSRTWVCDGYYDCEDGSDEVNCPTHT

SEQ ID NO: 574 - protein, 39 aa, Artificial Sequence
  Description of Artificial Sequence: Synthetic polypeptide
CRTSHFHCNNGHRLSRTWVCDGYEDCEDGSDEANCPTHT

SEQ ID NO: 575 - protein, 4 aa, Artificial Sequence
  Description of Artificial Sequence: Synthetic peptide
PTHT

SEQ ID NO: 576 - protein, 48 aa, Artificial Sequence
  Description of Artificial Sequence: Synthetic polypeptide
CEPEEFRCRSGRCIPQTWLCDGLNDCGDGSDEPPAHCSAPASEPPGSL

SEQ ID NO: 577 - protein, 48 aa, Artificial Sequence
  Description of Artificial Sequence: Synthetic polypeptide
CQPDEFTCRSGRCIPQSWLCDGLNDCGDGSDEPPAHCSAPASEPPGSL

SEQ ID NO: 578 - protein, 48 aa, Artificial Sequence
  Description of Artificial Sequence: Synthetic polypeptide
CQPDEFTCSSGRCIPQIWLCDGLNDCGDGSDERPEHCSAPASEPPGSL

SEQ ID NO: 579 - protein, 48 aa, Artificial Sequence
  Description of Artificial Sequence: Synthetic polypeptide
CQSDEFMCSSGRCIPVHWLCDGLNDCGDGSDERPAQCSAPASEPPGSL

SEQ ID NO: 580 - protein, 50 aa, Artificial Sequence
  Description of Artificial Sequence: Synthetic polypeptide
CHSFNQFECRNRQCIPLYLVCDGVPDCADNSDETDCGDSYLPFSTPGPST

SEQ ID NO: 581 - protein, 51 aa, Artificial Sequence
  Description of Artificial Sequence: Synthetic polypeptide
CNSFNQFECRNRQCIPLYLVCDGVPDCGDNSDETYCGDSHILPFSTPGPST

SEQ ID NO: 582 - protein, 51 aa, Artificial Sequence
  Description of Artificial Sequence: Synthetic polypeptide
CHTFNKFECRNGQCIPLYLVCDGVPDCGDNSDETACGDSHILPFSTPGPST

SEQ ID NO: 583 - protein, 51 aa, Artificial Sequence
  Description of Artificial Sequence: Synthetic polypeptide
CPWFHHFKCRNGQRIPLHLVCDGVPDCGDDSDETDCGDSHILPFSTPGPST

SEQ ID NO: 584 - protein, 87 aa, Artificial Sequence
  Description of Artificial Sequence: Synthetic polypeptide
CAPDQFRCSSGQCIPETWLCDGDDDCVDSSDEAGCASTVPTCLPDEFQCGSGRCIPQTWVCDGLNDCGDGSDESPAHCSQDPEFHKV

SEQ ID NO: 585 - protein, 85 aa, Artificial Sequence
  Description of Artificial Sequence: Synthetic polypeptide
CGPDQFRCKSGNCLPLNWVCDGVDDCGDSSDEEGCATPTCLPDEFQCGSGRCIPQTWVCDGLNDCGDGSDESPAHCSQDPEFHKV

SEQ ID NO: 586 - protein, 85 aa, Artificial Sequence
  Description of Artificial Sequence: Synthetic polypeptide
CGPDQFKCNSGSCIPLTWVCDGDNDCGDDSDETDCTKRTCLPDEFQCGSGRCIPQTWVCDGLNDCGDGSDESPAHCSQDPEFHKV

SEQ ID NO: 587 - protein, 82 aa, Artificial Sequence
  Description of Artificial Sequence: Synthetic polypeptide
CPPDQFRCRSGRCIPQHWLCDGLNDCGDGSDEANCEKRTCLPDEFQCGSGRCIPQTWVCDGLNDCGDGSDESPATCKAPVPT

SEQ ID NO: 588 - protein, 90 aa, Artificial Sequence
  Description of Artificial Sequence: Synthetic polypeptide
CLPDEFQCGSGRCIPQTWVCDGLNDCGDGSDESPAHCSQDPEFHKVCPSNQFPCRSTGICIPLAWVCDGLNDCGDGSDESPATCKAPVPT

SEQ ID NO: 589 - protein, 88 aa, Artificial Sequence
  Description of Artificial Sequence: Synthetic polypeptide
CLPDEFRCGSGRCIPQTWVCDGLNDCGDGSDETGCRRPGPTCLPDEFQCGSGRCIPQTWVCDGLNDCGDGSDESQQCSAPASEPPGSL

SEQ ID NO: 590 - protein, 89 aa, Artificial Sequence
  Description of Artificial Sequence: Synthetic polypeptide
CGPDEFRCNSGRCLPLDWRCDGVDDCEDGSDEAPDLCKTPARTCLPDEFQCGSGRCIPQTWVCDGLNDCGDGSDESPAHCSQDPEFHKV

SEQ ID NO: 591 - protein, 6 aa, Artificial Sequence
  Description of Artificial Sequence: Synthetic peptide
ASTVPT

SEQ ID NO: 592 - protein, 4 aa, Artificial Sequence
  Description of Artificial Sequence: Synthetic peptide
ATPT

SEQ ID NO: 593 - protein, 4 aa, Artificial Sequence
  Description of Artificial Sequence: Synthetic peptide
TKRT

SEQ ID NO: 594 - protein, 4 aa, Artificial Sequence
  Description of Artificial Sequence: Synthetic peptide
EKRT

SEQ ID NO: 595 - protein, 6 aa, Artificial Sequence
  Description of Artificial Sequence: Synthetic peptide
RRPGPT

SEQ ID NO: 596 - protein, 6 aa, Artificial Sequence
  Description of Artificial Sequence: Synthetic peptide
KTPART

SEQ ID NO: 597 - protein, 37 aa, Artificial Sequence
  Description of Artificial Sequence: Synthetic polypeptide
  MOD_RES (9)..(9): Ser or Gly
  MOD_RES (17)..(17): His or Thr
  MOD_RES (19)..(19): Val or Leu
  MOD_RES (33)..(33): Pro or Ser
  MOD_RES (36)..(36): His or Thr
CLPDEFQCXSGRCIPQXWXCDGLNDCGDGSDEXPAXC

SEQ ID NO: 598 - protein, 89 aa, Artificial Sequence
  Description of Artificial Sequence: Synthetic polypeptide
CLPDEFQCGSGRCIPQTWVCDGLNDCGDGSDEPPAHCSAPASEPPGSLCRSDEFRCGNGRCIPLTWVCDGEDDCQDSSDETGCTTPGHT

SEQ ID NO: 599 - protein, 87 aa, Artificial Sequence
  Description of Artificial Sequence: Synthetic polypeptide
CLPDEFQCGSGRCIPQTWVCDGLNDCGDGSDEPPAHCSAPASEPPGSLCRSNQFTCGNGNCIPQPWVCDGEDDCGDDSDEESCKEHT

SEQ ID NO: 600 - protein, 84 aa, Artificial Sequence
  Description of Artificial Sequence: Synthetic polypeptide
CLPDEFQCGSGRCIPQTWVCDGLNDCGDGSDESPATCKAPVPTCLPDEFKCGSGRCIPLRWVCDGDDDCQDGSDETDCGGAEPT

SEQ ID NO: 601 - protein, 85 aa, Artificial Sequence
  Description of Artificial Sequence: Synthetic polypeptide
CLPDEFQCGSGRCIPQTWVCDGLNDCGDGSDESPAHCSQDPEFHKVCLSDQFRCGNGRCVPRAWLCDGDNDCQDGSDETNCEQPT

SEQ ID NO: 602 - protein, 88 aa, Artificial Sequence
  Description of Artificial Sequence: Synthetic polypeptide
CLPDEFQCGSGRCIPQTWVCDGLNDCGDGSDESPAHCSQDPEFHKVCESIGQFECGNGHCIPPTWLCDGVNDCQDSSDEALAHCEPPT

SEQ ID NO: 603 - protein, 85 aa, Artificial Sequence
  Description of Artificial Sequence: Synthetic polypeptide
CLPDEFQCGSGRCIPQTWVCDGLNDCGDGSDESPAHCSQDPEFHKVCQSNEFRCRNGQCIPLTWLCDGDNDCLDSSDEESCPAHT

SEQ ID NO: 604 - protein, 87 aa, Artificial Sequence
  Description of Artificial Sequence: Synthetic polypeptide
CLPDEFQCGSGRCIPQTWVCDGLNDCGDGSDESPAHCSQDPEFHKVCPPGQFRCNNGRCIPVHWRCDGENDCQDDSDEKSCKGPEHT

SEQ ID NO: 605 - protein, 87 aa, Artificial Sequence
  Description of Artificial Sequence: Synthetic polypeptide
CLPDEFQCGSGRCIPQTWVCDGLNDCGDGSDESPAHCSQDPEFHKVCLPGQFPCGNGRCIPETWLCDGDDDCQDGSDEKGCTASGRT

SEQ ID NO: 606 - protein, 87 aa, Artificial Sequence
  Description of Artificial Sequence: Synthetic polypeptide
CLPDEFQCGSGRCIPQTWVCDGLNDCGDGSDESPAHCSQDPEFHKVCPSGEFTCGSGRCIPPTWVCDGEPDCLDGSDEKSCTATVRT

SEQ ID NO: 607 - protein, 37 aa, Artificial Sequence
  Description of Artificial Sequence: Synthetic polypeptide
CLPDEFQCGSGRCIPQTWVCDGLNDCGDGSDEPPAHC

SEQ ID NO: 608 - protein, 6 aa, Artificial Sequence
  Description of Artificial Sequence: Synthetic peptide
TTPGHT

SEQ ID NO: 609 - protein, 4 aa, Artificial Sequence
  Description of Artificial Sequence: Synthetic peptide
AQPT

SEQ ID NO: 610 - protein, 4 aa, Artificial Sequence
  Description of Artificial Sequence: Synthetic peptide
KEHT

SEQ ID NO: 611 - protein, 6 aa, Artificial Sequence
  Description of Artificial Sequence: Synthetic peptide
GGAEPT

SEQ ID NO: 612 - protein, 4 aa, Artificial Sequence
  Description of Artificial Sequence: Synthetic peptide
TEHT

SEQ ID NO: 613 - protein, 6 aa, Artificial Sequence
  Description of Artificial Sequence: Synthetic peptide
ERSGRT

SEQ ID NO: 614 - protein, 4 aa, Artificial Sequence
  Description of Artificial Sequence: Synthetic peptide
EQPT

SEQ ID NO: 615 - protein, 4 aa, Artificial Sequence
  Description of Artificial Sequence: Synthetic peptide
EPPT

SEQ ID NO: 616 - protein, 4 aa, Artificial Sequence
  Description of Artificial Sequence: Synthetic peptide
PAHT

SEQ ID NO: 617 - protein, 6 aa, Artificial Sequence
  Description of Artificial Sequence: Synthetic peptide
KGPEHT

SEQ ID NO: 618 - protein, 6 aa, Artificial Sequence
  Description of Artificial Sequence: Synthetic peptide
TASGRT

SEQ ID NO: 619 - protein, 6 aa, Artificial Sequence
  Description of Artificial Sequence: Synthetic peptide
TATVRT

SEQ ID NO: 620 - protein, 94 aa, Artificial Sequence
  Description of Artificial Sequence: Synthetic polypeptide
CASNQFRCGNGHCLSRTWLCDGVNDCEDGSDEADCSAPASEPPGSLCPPSQFTCGNGRCVSLGWVCDGLNDCGDGSDESPALCSAPASEPPGSL

SEQ ID NO: 621 - protein, 90 aa, Artificial Sequence
  Description of Artificial Sequence: Synthetic polypeptide
CAPDEFRCHNTGTCIPRAWLCDGDNDCGDGSDEEGCKGSGPTCPPSQFTCGNGRCVSLGWVCDGLNDCGDGSDESPALCSAPASEPPGSL

SEQ ID NO: 622 - protein, 90 aa, Artificial Sequence
  Description of Artificial Sequence: Synthetic polypeptide
CAPSQFQCHDNNICLLEGLLCDGEDDCADGSDEADCAAPEHTCPPSQFTCGNGRCVSLGWVCDGLNDCGDGSDESPALCSAPASEPPGSL

SEQ ID NO: 623 - protein, 6 aa, Artificial Sequence
  Description of Artificial Sequence: Synthetic peptide
KGSGPT

SEQ ID NO: 624 - protein, 6 aa, Artificial Sequence
  Description of Artificial Sequence: Synthetic peptide
AAPEHT

SEQ ID NO: 625 - protein, 37 aa, Artificial Sequence; identical to SEQ ID NO: 156
  Description of Artificial Sequence: Synthetic polypeptide

SEQ ID NO: 626 - protein, 91 aa, Artificial Sequence
  Description of Artificial Sequence: Synthetic polypeptide
CPPSQFTCGNGRCVSLGWVCDGLNDCGDGSDESPALCSAPASEPPGSLCAPGEFTCKSGQCIPLHWLCDGDNDCGDNSDESPATCKATVPT

SEQ ID NO: 627 - protein, 89 aa, Artificial Sequence
  Description of Artificial Sequence: Synthetic polypeptide
CPPSQFTCGNGRCVSLGWVCDGLNDCGDGSDESPALCSAPASEPPGSLCPPGQFRCNNGRCIPQPWLCDGDDDCQDNSDEENCESPGPT

SEQ ID NO: 628 - protein, 89 aa, Artificial Sequence
  Description of Artificial Sequence: Synthetic polypeptide
CPPSQFTCGNGRCVSLGWVCDGLNDCGDGSDESPALCSAPASEPPGSLCPPDQFRCRNGRCVPLAWVCDGEDDCQDNSDETDCKRSVRT

SEQ ID NO: 629 - protein, 6 aa, Artificial Sequence
  Description of Artificial Sequence: Synthetic peptide
KATVPT

SEQ ID NO: 630 - protein, 6 aa, Artificial Sequence
  Description of Artificial Sequence: Synthetic peptide
ESPGPT

SEQ ID NO: 631 - protein, 6 aa, Artificial Sequence
  Description of Artificial Sequence: Synthetic peptide
KRSVRT

SEQ ID NO: 632 - protein, 92 aa, Artificial Sequence
  Description of Artificial Sequence: Synthetic polypeptide
CRPNEFRCGNGHCLSQTWVCDGVDDCLDGSDEESCGRPGPGATSAPAACPSNQFPCRGTGICIPLAWVCDGLNDCGDGSDESPATCKAPVPT

SEQ ID NO: 633 - protein, 89 aa, Artificial Sequence
  Description of Artificial Sequence: Synthetic polypeptide
CAPGEFTCKNTGRCIPLNWRCDGDDDCGDGSDETDCPAPTCPSNQFPCRSTGICIPLAWVCDGLNDCGDGSDESPAHCSAPASEPPGSL

SEQ ID NO: 634 - protein, 88 aa, Artificial Sequence
  Description of Artificial Sequence: Synthetic polypeptide
CGPSQFQCSNGRCLPATWVCDGDDDCLDGSDEASATCATRTCPSNQFPCRSTGICIPLAWVCDGLNDCGDGSDESPAHCSQDPGFHKV

SEQ ID NO: 635 - protein, 4 aa, Artificial Sequence
  Description of Artificial Sequence: Synthetic peptide
PAPT

SEQ ID NO: 636 - protein, 4 aa, Artificial Sequence
  Description of Artificial Sequence: Synthetic peptide
KAHT

SEQ ID NO: 637 - protein, 4 aa, Artificial Sequence
  Description of Artificial Sequence: Synthetic peptide
ATRT

SEQ ID NO: 638 - protein, 38 aa, Artificial Sequence
  Description of Artificial Sequence: Synthetic polypeptide
CPSNQFPCRGTGICIPLAWVCDGLNDCGDGSDESPATC

SEQ ID NO: 639 - protein, 85 aa, Artificial Sequence
  Description of Artificial Sequence: Synthetic polypeptide
CASGEFTCNNGQCVPLAWRCDGVNDCQDGSDEKGCTPHTCQSNEFRCRSGRCIPQHWLCDGLNDCGDGSDESPAHCSQDPEFHKV

SEQ ID NO: 640 - protein, 89 aa, Artificial Sequence
  Description of Artificial Sequence: Synthetic polypeptide
CGPDEFRCNNGQCIPLPWRCDGVDDCGDNSDEPLEICQAPTCQSNEFRCRSGRCIPQHWLCDGLNDCGDGSDEPPAHCSAPASEPPGSL

SEQ ID NO: 641 - protein, 89 aa, Artificial Sequence
  Description of Artificial Sequence: Synthetic polypeptide
CPPDEFQCRGTKKCLPLAWVCDGDNDCEDDSDEESCASAVHTCQSNEFRCRSGRCIPQHWLCDGLNDCGDGSDESQQCSAPASEPPGSL

SEQ ID NO: 642 - protein, 88 aa, Artificial Sequence
  Description of Artificial Sequence: Synthetic polypeptide
CGPDQFRCSSGKCIPQHWLCDGLNDCGDGSDESPATCQRHTCQSNEFRCRSGRCIPQHWLCDGLNDCGDGSDESQQCSAPASEPPGSL

SEQ ID NO: 643 - protein, 100 aa, Artificial Sequence
  Description of Artificial Sequence: Synthetic polypeptide
CGANEFQCRSTGICVPVEWVCDGDNDCGDGSDEPPVCGDSHILPFSTPGPSTCQPDEFTCSSGRCIPQPWLCDGLNDCGDGSDEPPAHCSAPASEPPGSL

SEQ ID NO: 644 - protein, 4 aa, Artificial Sequence
  Description of Artificial Sequence: Synthetic peptide
TPHT

SEQ ID NO: 645 - protein, 4 aa, Artificial Sequence
  Description of Artificial Sequence: Synthetic peptide
QAPT

SEQ ID NO: 646 - protein, 4 aa, Artificial Sequence
  Description of Artificial Sequence: Synthetic peptide
ETPT

SEQ ID NO: 647 - protein, 6 aa, Artificial Sequence
  Description of Artificial Sequence: Synthetic peptide
ASAVHT

SEQ ID NO: 648 - protein, 4 aa, Artificial Sequence
  Description of Artificial Sequence: Synthetic peptide
QRHT

SEQ ID NO: 649 - protein, 37 aa, Artificial Sequence
  Description of Artificial Sequence: Synthetic polypeptide
  MOD_RES (33)..(33): Ser or Pro
  MOD_RES (34)..(34): Not present or Pro
  MOD_RES (35)..(35): Ala or Gln
CQSNEFRCRSGRCIPQHWLCDGLNDCGDGSDEXXXQC

SEQ ID NO: 650 - protein, 86 aa, Artificial Sequence
  Description of Artificial Sequence: Synthetic polypeptide
CQSNEFRCRSGRCIPQHWLCDGLNDCGDGSDESQQCSAPASEPPGSLCPPGQFRCRNGSCIPATWLCDGDNDCGDNSDEEDCTPPT

SEQ ID NO: 651 - protein, 87 aa, Artificial Sequence
  Description of Artificial Sequence: Synthetic polypeptide
CQSNEFRCRSGRCIPQHWLCDGLNDCGDGSDEPPAHCSAPASEPPGSLCAANQFTCGNGNCIPLHWVCDGDNDCQDGSDETNCEEHT

SEQ ID NO: 652 - protein, 4 aa, Artificial Sequence
  Description of Artificial Sequence: Synthetic peptide
TPPT

SEQ ID NO: 653 - protein, 4 aa, Artificial Sequence
  Description of Artificial Sequence: Synthetic peptide
EEHT

SEQ ID NO: 654 - protein, 98 aa, Artificial Sequence
  Description of Artificial Sequence: Synthetic polypeptide
CPSGQFQCNNGHCLSATWLCDGVDDCGDGSDEKGCGDSHILPFSTPGPSTCQPDEFTCSSGRCIPQPWLCDGLNDCGDGSDEPPAHCSAPASEPPGSL

SEQ ID NO: 655 - protein, 90 aa, Artificial Sequence
  Description of Artificial Sequence: Synthetic polypeptide
CRPDEFPCRSTGRCVPRRWVCDGVDDCGDNSDESLAHCQTPTCQPDEFTCSSGRCIPQPWLCDGLNDCGDGSDEPPAHCSAPASEPPGSL

SEQ ID NO: 656 - protein, 94 aa, Artificial Sequence
  Description of Artificial Sequence: Synthetic polypeptide
CAPDQFRCKSGNCIPLAWRCDGEDDCRDGSDEESCSAPASEPPGSLCQPDEFTCSSGRCIPQPWLCDGLNDCGDGSDEPPAHCSAPASEPPGSL

SEQ ID NO: 657 - protein, 84 aa, Artificial Sequence
  Description of Artificial Sequence: Synthetic polypeptide
CQAGQFQCESGNCVPPNWLCDGENDCADSSDEANCRRAAHTCQPDEFTCSSGRCIPLAWVCDGLNDCGDGSDESPATCKAPVPT

SEQ ID NO: 658 - protein, 4 aa, Artificial Sequence
  Description of Artificial Sequence: Synthetic peptide
QTPT

SEQ ID NO: 659 - protein, 37 aa, Artificial Sequence
  Description of Artificial Sequence: Synthetic polypeptide
  MOD_RES (16)..(16): Leu or Gln
  MOD_RES (17)..(17): Ala or Pro
  MOD_RES (19)..(19): Leu or Val
CQPDEFTCSSGRCIPXXWXCDGLNDCGDGSDEPPAHC

SEQ ID NO: 660 - protein, 89 aa, Artificial Sequence
  Description of Artificial Sequence: Synthetic polypeptide
CQPDEFTCSSGRCIPQPWLCDGLNDCGDGSDEPPAHCSAPASEPPGSLCRPDEFRCKNGRCIPQTWVCDGEDDCQDSSDETDCESTVRT

SEQ ID NO: 661 - protein, 87 aa, Artificial Sequence
  Description of Artificial Sequence: Synthetic polypeptide
CQPDEFTCSSGRCIPQPWLCDGLNDCGDGSDEPPAHCSAPASEPPGSLCRPDEFRCRNGRCVPLTWRCDGEDDCQDGSDEEGCAPPT

SEQ ID NO: 662 - protein, 85 aa, Artificial Sequence
  Description of Artificial Sequence: Synthetic polypeptide
CQPDEFQCGSGRCIPQTWVCDGLNDCGDGSDESPAHCSQDPEFHKVCRPGEFQCGSGHCIPGPWVCDGDPDCQDGSDEANCEQRT

SEQ ID NO: 663 - protein, 37 aa, Artificial Sequence; identical to SEQ ID NO: 160
  Description of Artificial Sequence: Synthetic polypeptide

SEQ ID NO: 664 - protein, 6 aa, Artificial Sequence
  Description of Artificial Sequence: Synthetic peptide
ESTVRT

SEQ ID NO: 665 - protein, 4 aa, Artificial Sequence
  Description of Artificial Sequence: Synthetic peptide
APPT

SEQ ID NO: 666 - protein, 91 aa, Artificial Sequence
  Description of Artificial Sequence: Synthetic polypeptide
CAAGQFRCHNSDTCLPGAWVCDGDNDCGDNSDEASCQKRTCHSFNQFECRNGQCIPLHLVCDGVPDCGDNSDETDCGDSHILPFSTPGPST

SEQ ID NO: 667 - protein, 91 aa, Artificial Sequence
  Description of Artificial Sequence: Synthetic polypeptide
CAPNEFRCRSTGRCIPVNWVCDGDDDCADNSDEAGCPEPTCHSFNRFECRNGQCIPLHLVCDGVPDCGDNSDETDCGDSHILPFSTPGPST

SEQ ID NO: 668 - protein, 91 aa, Artificial Sequence
  Description of Artificial Sequence: Synthetic polypeptide
CAPGEFQCSNGNCLPPNWLCDGVDDCGDGSDESADCTEPTCHSFNQFECRNGQCIPLHLVCDGVPDCGDNSDETDCGDPHILPFSTPGPST

SEQ ID NO: 669 - protein, 92 aa, Artificial Sequence
  Description of Artificial Sequence: Synthetic polypeptide
CAPDEFRCRNGNCIPLPWVCDGENDCRDDSDEEDCEAPGRTCHSFNQFECRNGQCIPLHLVCDGVPDCGDNSDETDCGDSHILPFSTPGPST

SEQ ID NO: 670 - protein, 92 aa, Artificial Sequence
  Description of Artificial Sequence: Synthetic polypeptide
CAAGEFQCSSGRCLPRPWVCDGDNDCGDDSDETNCRASAHTCHSFNQFECRNGQCIPLHLVCDGVPDCGDNSDETDCGDSHILPFSTPGPST

SEQ ID NO: 671 - protein, 99 aa, Artificial Sequence
  Description of Artificial Sequence: Synthetic polypeptide
CRSGEFRCKNGRCIPQHWVCDGENDCGDDSDETNCGRQGPGATSAPAACHSFNQFECRNGQCIPLHLVCDGVPDCGDNSDETDCGDSHILPFSTPGPST

SEQ ID NO: 672 - protein, 95 aa, Artificial Sequence
  Description of Artificial Sequence: Synthetic polypeptide
CGADQFQCGSGRCVPATWRCDGEDDCGDGSDEENCSQDPEFHKVCHSFNQFECRNGQCIPLHLVCDGVPDCGDNSDETDCGDSHILPFSTPGPST

SEQ ID NO: 673 - protein, 91 aa, Artificial Sequence
  Description of Artificial Sequence: Synthetic polypeptide
CLSDQFQCNNYETCIPRPWLCDGDDDCVDGSDEEDCETRTCHSFNQFECRNGQCIPLHLVCDGVPDCGDNSDETDCGDSHILPFSTPGPST

SEQ ID NO: 674 - protein, 90 aa, Artificial Sequence
  Description of Artificial Sequence: Synthetic polypeptide
CLPGQFTCGNGRCIPLPWVCDGVNDCEDNSDEESCEQHTCHSFNQFECRNGQCIPLHLVCDGVPDCGDNSDETDCGDSHILPFSTPGPST

SEQ ID NO: 675 - protein, 4 aa, Artificial Sequence
  Description of Artificial Sequence: Synthetic peptide
QKRT

SEQ ID NO: 676 - protein, 4 aa, Artificial Sequence
  Description of Artificial Sequence: Synthetic peptide
PEPT

SEQ ID NO: 677 - protein, 4 aa, Artificial Sequence
  Description of Artificial Sequence: Synthetic peptide
TEPT

SEQ ID NO: 678 - protein, 6 aa, Artificial Sequence
  Description of Artificial Sequence: Synthetic peptide
EAPGRT

SEQ ID NO: 679 - protein, 6 aa, Artificial Sequence
  Description of Artificial Sequence: Synthetic peptide
RASAHT

SEQ ID NO: 680 - protein, 13 aa, Artificial Sequence
  Description of Artificial Sequence: Synthetic peptide
GRQGPGATSAPAA

SEQ ID NO: 681 - protein, 4 aa, Artificial Sequence
  Description of Artificial Sequence: Synthetic peptide
ETRT

SEQ ID NO: 682 - protein, 4 aa, Artificial Sequence
  Description of Artificial Sequence: Synthetic peptide
EQHT

SEQ ID NO: 683 - protein, 36 aa, Artificial Sequence; identical to SEQ ID NO: 170
  Description of Artificial Sequence: Synthetic polypeptide

SEQ ID NO: 684 - protein, 15 aa, Artificial Sequence
  Description of Artificial Sequence: Synthetic peptide
GDPHILPFSTPGPST

SEQ ID NO: 685 - protein, 93 aa, Artificial Sequence
  Description of Artificial Sequence: Synthetic polypeptide
CHSFNQFECRNGQCIPLHLVCDGVPDCGDNSDETDCGDSHILPFSTPGPSTCQSGEFRCQNTRTCLPLKLLCDGVDDCLDDSDEKDCGTTGRT

SEQ ID NO: 686 - protein, 99 aa, Artificial Sequence
  Description of Artificial Sequence: Synthetic polypeptide
CHSFNQFECRNGQCIPLHLVCDGVPDCGDNSDETDCGDSHILPFSTPGPSTCLPGQFRCKTGRCIPRAWVCDGVDDCEDDSDEADCGRPGPGATSAPAA

SEQ ID NO: 687 - protein, 6 aa, Artificial Sequence
  Description of Artificial Sequence: Synthetic peptide
GTTGRT

SEQ ID NO: 688 - DNA, 33 bp, Artificial Sequence
  Description of Artificial Sequence: Synthetic primer
ggtcatactgaaccgatggccggtccggcctac

SEQ ID NO: 689 - DNA, 28 bp, Artificial Sequence
  Description of Artificial Sequence: Synthetic primer
aaaaggccccagaggccttctgcaatga

SEQ ID NO: 690 - DNA, 31 bp, Artificial Sequence
  Description of Artificial Sequence: Synthetic primer
atgccccgggtctggaggcgtctggtggttc

SEQ ID NO: 691 - DNA, 42 bp, Artificial Sequence
  Description of Artificial Sequence: Synthetic primer
ggtaccatgcttgcattcggccccagaggccttctgcaatga

SEQ ID NO: 692 - DNA, 15 bp, Artificial Sequence
  Description of Artificial Sequence: Synthetic primer
ggtcatactgaaccg

SEQ ID NO: 693 - DNA, 18 bp, Artificial Sequence
  Description of Artificial Sequence: Synthetic primer
ggtaccatgcttgcattc

SEQ ID NO: 694 - protein, 45 aa, Artificial Sequence; identical to SEQ ID NO: 288
  Description of Artificial Sequence: Synthetic polypeptide

SEQ ID NO: 695 - protein, 45 aa, Artificial Sequence; identical to SEQ ID NO: 301
  Description of Artificial Sequence: Synthetic polypeptide

SEQ ID NO: 696 - protein, 45 aa, Artificial Sequence; identical to SEQ ID NO: 302
  Description of Artificial Sequence: Synthetic polypeptide

SEQ ID NO: 697 - protein, 45 aa, Artificial Sequence; identical to SEQ ID NO: 303
  Description of Artificial Sequence: Synthetic polypeptide

SEQ ID NO: 698 - protein, 29 aa, Artificial Sequence
  Description of Artificial Sequence: Synthetic peptide
  MOD_RES (1)..(1): Glu or Gln
  MOD_RES (3)..(3): Any amino acid
  MOD_RES (6)..(6): Any amino acid
  MOD_RES (7)..(7): Ser or Thr
  MOD_RES (8)..(8): Any amino acid
  MOD_RES (11)..(11): Ile or Val
  MOD_RES (12)..(14): Any amino acid
  MOD_RES (16)..(16): Ile, Leu or Val
  MOD_RES (20)..(21): Any amino acid
  MOD_RES (24)..(24): Any amino acid
  MOD_RES (26)..(26): Asp or Asn
XFXCRXXXRCXXXXWXCDGXXDCXDXSDE

SEQ ID NO: 699 - protein, 26 aa, Artificial Sequence
  Description of Artificial Sequence: Synthetic peptide
  MOD_RES (2)..(2): Any amino acid
  MOD_RES (10)..(11): Any amino acid
  MOD_RES (17)..(18): Any amino acid
  MOD_RES (23)..(23): Any amino acid
CXSSGRCIPXXWVCDGXXDCRDXSDE

SEQ ID NO: 700 - protein, 26 aa, Artificial Sequence
  Description of Artificial Sequence: Synthetic peptide
  MOD_RES (2)..(2): Any amino acid
  MOD_RES (10)..(11): Any amino acid
  MOD_RES (17)..(18): Any amino acid
  MOD_RES (23)..(23): Any amino acid
CXSSGRCIPXXWLCDGXXDCRDXSDE

SEQ ID NO: 701 - protein, 51 aa, Artificial Sequence
  Description of Artificial Sequence: Synthetic polypeptide
CRSSQFQCNDSRICIPGRWRCDGDNDCQDGSDETGCGDSHILPFSTPGPST

SEQ ID NO: 702 - protein, 48 aa, Artificial Sequence
  Description of Artificial Sequence: Synthetic polypeptide
CPAGEFPCKNGQCLPVTWLCDGVNDCLDGSDEKGCGRPGPGATSAPAA

SEQ ID NO: 703 - protein, 48 aa, Artificial Sequence
  Description of Artificial Sequence: Synthetic polypeptide
CPPDEFPCKNGQCIPQDWLCDGVNDCLDGSDEKDCGRPGPGATSAPAA

SEQ ID NO: 704 - protein, 41 aa, Artificial Sequence
  Description of Artificial Sequence: Synthetic polypeptide
CGAGQFPCKNGHCLPLNLLCDGVNDCEDNSDEPSELCKALT

SEQ ID NO: 705 - protein, 182 aa, Artificial Sequence
  Description of Artificial Sequence: Synthetic polypeptide
CLPDEFQCGSGRCIPQHWLCDGLNDCGDGSDEPPAHCSAPASEPPGSLCRAGEFRCSNGRCVPLTWLCDGEDDCQDNSDEKNCAQPTCGANQFTCHNTNICISQAWVCDGVDDCEDNSDEKNCSAPASEPPGSLCHPTGQFRCRSSGRCVSPTWVCDGDRDCWDGSDEDNCSAPASEPPGSL

SEQ ID NO: 706 - protein, 182 aa, Artificial Sequence
  Description of Artificial Sequence: Synthetic polypeptide
CHPTGQFRCRSSGRCVSPTWVCDGDRDCWDGSDEDNCSAPASEPPGSLCLPDEFQCGSGRCIPQHWLCDGLNDCGDGSDEPPAHCSAPASEPPGSLCRAGEFRCSNGRCVPLTWLCDGEDDCQDNSDEKNCAQPTCGANQFTCHNTNICISQAWVCDGVDDCEDNSDEKNCSAPASEPPGSL

SEQ ID NO: 707 - protein, 186 aa, Artificial Sequence
  Description of Artificial Sequence: Synthetic polypeptide
CGADQFRCGNGSCVPRAWRCDGVDDCGDGSDEAPEICETPTCQSNEFRCRSGRCIPQHWLCDGLNDCGDGSDESQQCSAPASEPPGSLCGEGLFTCRSTNICISHAWVCDGVDDCEDNSDENNCSAPASEPPGSLCHPTGQFRCRSSGRCVSPTWVCDGDRDCWDGSDEDNCSAPASEPPGSLSLQ

SEQ ID NO: 708 - protein, 184 aa, Artificial Sequence
  Description of Artificial Sequence: Synthetic polypeptide
CGADQFRCGNGSCVPRAWRCDGVDDCGDGSDEAPEICETPTCQSNEFRCRSGRCIPQHWLCDGLNDCGDGSDESQQCSAPASEPPGSLCGTNLFTCRSTNMCISQAWVCDGVDDCEDNSDETVCSQDPEFHRVCHPTGQFRCRSSGRCVSPTWVCDGDRDCWDGSDEDNCSAPASEPPGSLSLQ

SEQ ID NO: 709 - protein, 186 aa, Artificial Sequence
  Description of Artificial Sequence: Synthetic polypeptide
CHPTGQFRCRSSGRCVSPTWVCDGDRDCWDGSDEDNCSAPASEPPGSLCGADQFRCGNGSCVPRAWRCDGVDDCGDGSDEAPEICETPTCQSNEFRCRSGRCIPQHWLCDGLNDCGDGSDESQQCSAPASEPPGSLCGEGLFTCRSTNICISHAWVCDGVDDCEDNSDENNCSAPASEPPGSLSLQ

SEQ ID NO: 710 - protein, 184 aa, Artificial Sequence
  Description of Artificial Sequence: Synthetic polypeptide
CHPTGQFRCRSSGRCVSPTWVCDGDRDCWDGSDEDNCSAPASEPPGSLCGADQFRCGNGSCVPRAWRCDGVDDCGDGSDEAPEICETPTCQSNEFRCRSGRCIPQHWLCDGLNDCGDGSDESQQCSAPASEPPGSLCGTNLFTCRSTNMCISQAWVCDGVDDCEDNSDETVCSQDPEFHRVSLQ

SEQ ID NO: 711 - protein, 730 aa, Artificial Sequence
  Description of Artificial Sequence: Synthetic polypeptide
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGGSGGGGSCGADQFRCGNGSCVPRAWRCDGVDDCGDGSDEAPEICETPTCQSNEFRCRSGRCIPQHWLCDGLNDCGDGSDESQQCSAPASEPPGSLCGEGLFTCRSTNICISHAWVCDGVDDCEDNSDENNCSAPASEPPGSL

SEQ ID NO: 712 - protein, 728 aa, Artificial Sequence
  Description of Artificial Sequence: Synthetic polypeptide
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGGSGGGGSCGADQFRCGNGSCVPRAWRCDGVDDCGDGSDEAPEICETPTCQSNEFRCRSGRCIPQHWLCDGLNDCGDGSDESQQCSAPASEPPGSLCGTNLFTCRSTNMCISQAWVCDGVDDCEDNSDETVCSQDPEFHKV

SEQ ID NO: 713 - protein, 734 aa, Artificial Sequence
  Description of Artificial Sequence: Synthetic polypeptide
SGGSCGADQFRCGNGSCVPRAWRCDGVDDCGDGSDEAPEICETPTCQSNEFRCRSGRCIPQHWLCDGLNDCGDGSDESQQCSAPASEPPGSLCGEGLFTCRSTNICISHAWVCDGVDDCEDNSDENNCSAPASEPPGSLGGGGSGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 714 - protein, 732 aa, Artificial Sequence
  Description of Artificial Sequence: Synthetic polypeptide
SGGSCGADQFRCGNGSCVPRAWRCDGVDDCGDGSDEAPEICETPTCQSNEFRCRSGRCIPQHWLCDGLNDCGDGSDESQQCSAPASEPPGSLCGTNLFTCRSTNMCISQAWVCDGVDDCEDNSDETVCSQDPEFHKVGGGGSGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 715 - protein, 585 aa, Artificial Sequence [sequence omitted]

SEQ ID NO: 716 - protein, 133 aa, Artificial Sequence
  Description of Artificial Sequence: Synthetic polypeptide
CGANLFTCQSTNICISPAWVCDGVDDCEDYSDEIGCSQDPEFHKVCGADQFRCGNGSCVPRAWRCDGVDDCGDGSDEAPEICETPTCQSNEFRCRSGRCIPQHWLCDGLNDCGDGSDESQQCSAPASEPPGSL

SEQ ID NO: 717 - protein, 133 aa, Artificial Sequence
  Description of Artificial Sequence: Synthetic polypeptide
CGADQFRCGNGSCVPRAWRCDGVDDCGDGSDEAPEICETPTCQSNEFRCRSGRCIPQHWLCDGLNDCGDGSDESQQCSAPASEPPGSLCGANLFTCQSTNICISPAWVCDGVDDCEDYSDEIGCSQDPEFHKV

SEQ ID NO: 718 - protein, 133 aa, Artificial Sequence
  Description of Artificial Sequence: Synthetic polypeptide
CGANLFTCRSSNICISPAWVCDGVDDCEDYSDEIGCSQDPEFHKVCGADQFRCGNGSCVPRAWRCDGVDDCGDGSDEAPEICETPTCQSNEFRCRSGRCIPQHWLCDGLNDCGDGSDESQQCSAPASEPPGSL

SEQ ID NO: 719 - protein, 133 aa, Artificial Sequence
  Description of Artificial Sequence: Synthetic polypeptide
CGADQFRCGNGSCVPRAWRCDGVDDCGDGSDEAPEICETPTCQSNEFRCRSGRCIPQHWLCDGLNDCGDGSDESQQCSAPASEPPGSLCGANLFTCRSSNICISPAWVCDGVDDCEDYSDEIGCSQDPEFHKV

SEQ ID NO: 720 - protein, 133 aa, Artificial Sequence
  Description of Artificial Sequence: Synthetic polypeptide
CGADQFRCGNGSCVPRAWRCDGVDDCGDGSDEAPEICETPTCQSNEFRCRSGRCIPQHWLCDGLNDCGDGSDESQQCSAPASEPPGSLCGANLFTCRSTNICISDAWVCDGVDDCEDYSDEIGCSQDPEFHKV

SEQ ID NO: 721 - protein, 133 aa, Artificial Sequence
  Description of Artificial Sequence: Synthetic polypeptide
CGANLFTCRSTNICISPAWVCDGVDDCEDNSDEIGCSQDPEFHKVCGADQFRCGNGSCVPRAWRCDGVDDCGDGSDEAPEICETPTCQSNEFRCRSGRCIPQHWLCDGLNDCGDGSDESQQCSAPASEPPGSL

SEQ ID NO: 722 - protein, 133 aa, Artificial Sequence
  Description of Artificial Sequence: Synthetic polypeptide
CGADQFRCGNGSCVPRAWRCDGVDDCGDGSDEAPEICETPTCQSNEFRCRSGRCIPQHWLCDGLNDCGDGSDESQQCSAPASEPPGSLCGANLFTCRSTNICISPAWVCDGVDDCEDNSDEIGCSQDPEFHKV

SEQ ID NO: 723 - protein, 133 aa, Artificial Sequence
  Description of Artificial Sequence: Synthetic polypeptide
CGANLFTCRSTNICISPAWVCDGVDDCEDYSDETGCSQDPEFHKVCGADQFRCGNGSCVPRAWRCDGVDDCGDGSDEAPEICETPTCQSNEFRCRSGRCIPQHWLCDGLNDCGDGSDESQQCSAPASEPPGSL

SEQ ID NO: 724 - protein, 133 aa, Artificial Sequence
  Description of Artificial Sequence: Synthetic polypeptide
CGADQFRCGNGSCVPRAWRCDGVDDCGDGSDEAPEICETPTCQSNEFRCRSGRCIPQHWLCDGLNDCGDGSDESQQCSAPASEPPGSLCGANLFTCRSTNICISPAWVCDGVDDCEDYSDETGCSQDPEFHKV

SEQ ID NO: 725 - protein, 133 aa, Artificial Sequence
  Description of Artificial Sequence: Synthetic polypeptide
CGANLFTCRSTNICISPAWVCDGVDDCEDYSDEITCSQDPEFHKVCGADQFRCGNGSCVPRAWRCDGVDDCGDGSDEAPEICETPTCQSNEFRCRSGRCIPQHWLCDGLNDCGDGSDESQQCSAPASEPPGSL

SEQ ID NO: 726 - protein, 133 aa, Artificial Sequence
  Description of Artificial Sequence: Synthetic polypeptide
CGADQFRCGNGSCVPRAWRCDGVDDCGDGSDEAPEICETPTCQSNEFRCRSGRCIPQHWLCDGLNDCGDGSDESQQCSAPASEPPGSLCGANLFTCRSTNICISPAWVCDGVDDCEDYSDEITCSQDPEFHKV

SEQ ID NO: 727 - protein, 133 aa, Artificial Sequence
  Description of Artificial Sequence: Synthetic polypeptide
CGANLFTCRSTNICISPAWVCDGVDDCEDYSDEIGCSQDPEFHRVCGADQFRCGNGSCVPRAWRCDGVDDCGDGSDEAPEICETPTCQSNEFRCRSGRCIPQHWLCDGLNDCGDGSDESQQCSAPASEPPGSL

SEQ ID NO: 728 - protein, 133 aa, Artificial Sequence
  Description of Artificial Sequence: Synthetic polypeptide
CGANLFTCQSTNICISPAWVCDGVDDCEDYSDEIGCSQDPEFHRVCGADQFRCGNGSCVPRAWRCDGVDDCGDGSDEAPEICETPTCQSNEFRCRSGRCIPQHWLCDGLNDCGDGSDESQQCSAPASEPPGSL

SEQ ID NO: 729 - protein, 133 aa, Artificial Sequence
  Description of Artificial Sequence: Synthetic polypeptide
CGADQFRCGNGSCVPRAWRCDGVDDCGDGSDEAPEICETPTCQSNEFRCRSGRCIPQHWLCDGLNDCGDGSDESQQCSAPASEPPGSLCGANLFTCQSTNICISPAWVCDGVDDCEDYSDEIGCSQDPEFHRV

SEQ ID NO: 730 - protein, 133 aa, Artificial Sequence
  Description of Artificial Sequence: Synthetic polypeptide
CGANLFTCRSSNICISPAWVCDGVDDCEDYSDEIGCSQDPEFHRVCGADQFRCGNGSCVPRAWRCDGVDDCGDGSDEAPEICETPTCQSNEFRCRSGRCIPQHWLCDGLNDCGDGSDESQQCSAPASEPPGSL

SEQ ID NO: 731 - protein, 133 aa, Artificial Sequence
  Description of Artificial Sequence: Synthetic polypeptide
CGADQFRCGNGSCVPRAWRCDGVDDCGDGSDEAPEICETPTCQSNEFRCRSGRCIPQHWLCDGLNDCGDGSDESQQCSAPASEPPGSLCGANLFTCRSSNICISPAWVCDGVDDCEDYSDEIGCSQDPEFHRV

SEQ ID NO: 732 - protein, 133 aa, Artificial Sequence
  Description of Artificial Sequence: Synthetic polypeptide
CGADQFRCGNGSCVPRAWRCDGVDDCGDGSDEAPEICETPTCQSNEFRCRSGRCIPQHWLCDGLNDCGDGSDESQQCSAPASEPPGSLCGANLFTCRSTNICISDAWVCDGVDDCEDYSDEIGCSQDPEFHRV

SEQ ID NO: 733 - protein, 133 aa, Artificial Sequence
  Description of Artificial Sequence: Synthetic polypeptide
CGANLFTCRSTNICISPAWVCDGVDDCEDNSDEIGCSQDPEFHRVCGADQFRCGNGSCVPRAWRCDGVDDCGDGSDEAPEICETPTCQSNEFRCRSGRCIPQHWLCDGLNDCGDGSDESQQCSAPASEPPGSL

SEQ ID NO: 734 - protein, 133 aa, Artificial Sequence
  Description of Artificial Sequence: Synthetic polypeptide
CGADQFRCGNGSCVPRAWRCDGVDDCGDGSDEAPEICETPTCQSNEFRCRSGRCIPQHWLCDGLNDCGDGSDESQQCSAPASEPPGSLCGANLFTCRSTNICISPAWVCDGVDDCEDNSDEIGCSQDPEFHRV

SEQ ID NO: 735 - protein, 133 aa, Artificial Sequence
  Description of Artificial Sequence: Synthetic polypeptide
CGANLFTCRSTNICISPAWVCDGVDDCEDYSDETGCSQDPEFHRVCGADQFRCGNGSCVPRAWRCDGVDDCGDGSDEAPEICETPTCQSNEFRCRSGRCIPQHWLCDGLNDCGDGSDESQQCSAPASEPPGSL

SEQ ID NO: 736 - protein, 133 aa, Artificial Sequence
  Description of Artificial Sequence: Synthetic polypeptide
CGADQFRCGNGSCVPRAWRCDGVDDCGDGSDEAPEICETPTCQSNEFRCRSGRCIPQHWLCDGLNDCGDGSDESQQCSAPASEPPGSLCGANLFTCRSTNICISPAWVCDGVDDCEDYSDETGCSQDPEFHRV

SEQ ID NO: 737 - protein, 133 aa, Artificial Sequence
  Description of Artificial Sequence: Synthetic polypeptide
CGANLFTCRSTNICISPAWVCDGVDDCEDYSDEITCSQDPEFHRVCGADQFRCGNGSCVPRAWRCDGVDDCGDGSDEAPEICETPTCQSNEFRCRSGRCIPQHWLCDGLNDCGDGSDESQQCSAPASEPPGSL

SEQ ID NO: 738 - protein, 133 aa, Artificial Sequence
  Description of Artificial Sequence: Synthetic polypeptide
CGADQFRCGNGSCVPRAWRCDGVDDCGDGSDEAPEICETPTCQSNEFRCRSGRCIPQHWLCDGLNDCGDGSDESQQCSAPASEPPGSLCGANLFTCRSTNICISPAWVCDGVDDCEDYSDEITCSQDPEFHRV

SEQ ID NO: 739 - protein, 133 aa, Artificial Sequence
  Description of Artificial Sequence: Synthetic polypeptide
CGADQFRCGNGSCVPRAWRCDGVDDCGDGSDEAPEICETPTCQSNEFRCRSGRCIPQHWLCDGLNDCGDGSDESQQCSAPASEPPGSLCGTNLFTCRSTNMCISQAWVCDGVDDCEDNSDETVCSQDPEFHRV

SEQ ID NO: 740 - protein, 134 aa, Artificial Sequence
  Description of Artificial Sequence: Synthetic polypeptide
CLPDEFQCGSGRCIPQHWLCDGLNDCGDGSDEPPAHCSAPASEPPGSLCRAGEFRCSNGRCVPLTWLCDGEDDCQDNSDERNCAQPTCGANQFTCHNTNICISQAWVCDGVDDCEDNSDERNCSAPASEPPGSL

SEQ ID NO: 741 - protein, 4 aa, Artificial Sequence
  Description of Artificial Sequence: Synthetic peptide
MDYK

SEQ ID NO: 742 - protein, 4 aa, Artificial Sequence
  Description of Artificial Sequence: Synthetic peptide
MHYK

SEQ ID NO: 743 - protein, 4 aa, Artificial Sequence
  Description of Artificial Sequence: Synthetic peptide
MHHK

SEQ ID NO: 744 - protein, 4 aa, Artificial Sequence
  Description of Artificial Sequence: Synthetic peptide
MRDK

SEQ ID NO: 745 - protein, 4 aa, Artificial Sequence
  Description of Artificial Sequence: Synthetic peptide
MRYK

SEQ ID NO: 746 - protein, 4 aa, Artificial Sequence
  Description of Artificial Sequence: Synthetic peptide
MYVK

SEQ ID NO: 747 - protein, 5 aa, Artificial Sequence
  Description of Artificial Sequence: Synthetic peptide
MDYSK

SEQ ID NO: 748 - protein, 5 aa, Artificial Sequence
  Description of Artificial Sequence: Synthetic peptide
MHYSK

SEQ ID NO: 749 - protein, 5 aa, Artificial Sequence
  Description of Artificial Sequence: Synthetic peptide
MHHSK

SEQ ID NO: 750 - protein, 5 aa, Artificial Sequence
  Description of Artificial Sequence: Synthetic peptide
MRDSK

SEQ ID NO: 751 - protein, 5 aa, Artificial Sequence
  Description of Artificial Sequence: Synthetic peptide
MRYSK

SEQ ID NO: 752 - protein, 5 aa, Artificial Sequence
  Description of Artificial Sequence: Synthetic peptide
MYVSK

SEQ ID NO: 753 - protein, 6 aa, Artificial Sequence
  Description of Artificial Sequence: Synthetic peptide
MDYSAK

SEQ ID NO: 754 - protein, 6 aa, Artificial Sequence
  Description of Artificial Sequence: Synthetic peptide
MHYSAK

SEQ ID NO: 755 - protein, 6 aa, Artificial Sequence
  Description of Artificial Sequence: Synthetic peptide
MHHSAK

SEQ ID NO: 756 - protein, 6 aa, Artificial Sequence
  Description of Artificial Sequence: Synthetic peptide
MRDSVK

SEQ ID NO: 757 - protein, 6 aa, Artificial Sequence
  Description of Artificial Sequence: Synthetic peptide
MRYSVK

SEQ ID NO: 758 - protein, 6 aa, Artificial Sequence
  Description of Artificial Sequence: Synthetic peptide
MYVSVK

SEQ ID NO: 759 - protein, 8 aa, Artificial Sequence
  Description of Artificial Sequence: Synthetic peptide
MRDSVSVK

SEQ ID NO: 760 - protein, 8 aa, Artificial Sequence
  Description of Artificial Sequence: Synthetic peptide
MRDSVYAK

SEQ ID NO: 761 - protein, 10 aa, Artificial Sequence
  Description of Artificial Sequence: Synthetic peptide
MRDSVRDSVK

SEQ ID NO: 762 - protein, 10 aa, Artificial Sequence
  Description of Artificial Sequence: Synthetic peptide
MRDSVYARDK

SEQ ID NO: 763 - protein, 12 aa, Artificial Sequence
  Description of Artificial Sequence: Synthetic peptide
MRDSVRDYASVK

SEQ ID NO: 764 - protein, 12 aa, Artificial Sequence
  Description of Artificial Sequence: Synthetic peptide
MRDSVGGGGSVK

SEQ ID NO: 765 - protein, 17 aa, Artificial Sequence
  Description of Artificial Sequence: Synthetic peptide
MRDSVGGGGSGGGGSVK

SEQ ID NO: 766 - protein, 22 aa, Artificial Sequence
  Description of Artificial Sequence: Synthetic peptide
MRDSVYARDYGGGGSGGGGSVK

SEQ ID NO: 767 - protein, 22 aa, Artificial Sequence
  Description of Artificial Sequence: Synthetic peptide
MRDSVGGGGSGGGGSGGGGSVK

SEQ ID NO: 768 - protein, 35 aa, Artificial Sequence
  Description of Artificial Sequence: Synthetic polypeptide
CEPYQFRCKNNRCVPGRWQCDYDNDCGDNSDEESC

SEQ ID NO: 769 - protein, 36 aa, Artificial Sequence
  Description of Artificial Sequence: Synthetic polypeptide
CLPSQFKCTNTNRCLPGIFRCNGQDNCGDGEDERDC

SEQ ID NO: 770 - protein, 35 aa, Artificial Sequence
  Description of Artificial Sequence: Synthetic polypeptide
CSQDEFRCHDGKCLSRQFVCDSDRDCLDGSDEASC

SEQ ID NO: 771 - protein, 35 aa, Artificial Sequence
  Description of Artificial Sequence: Synthetic polypeptide
CSSSAFTCGHGECLPAHWRCDKRNDCVDGSDEHNC

SEQ ID NO: 772 - protein, 36 aa, Artificial Sequence
  Description of Artificial Sequence: Synthetic polypeptide
CSSSEFQCASGRCIPQHWYCDQETDCFDASDEPASC

SEQ ID NO: 773 - protein, 36 aa, Artificial Sequence
  Description of Artificial Sequence: Synthetic polypeptide
CHSQGLVECRNGQCIPSTFQCDGDEDCKDGSDEENC

SEQ ID NO: 774 - protein, 35 aa, Artificial Sequence
  Description of Artificial Sequence: Synthetic polypeptide
CPAQTFRCSNGKCLSKSQQCNGKDDCGDGSDEASC

SEQ ID NO: 775 - protein, 34 aa, Artificial Sequence
  Description of Artificial Sequence: Synthetic polypeptide
CEGFVCAQTGRCVNRRLLCNGDNDCGDQSDEANC

SEQ ID NO: 776 - protein, 36 aa, Artificial Sequence
  Description of Artificial Sequence: Synthetic polypeptide
CTKHTYRCLNGLCLSKGNPECDGKEDCSDGSDEKDC

SEQ ID NO: 777 - protein, 38 aa, Artificial Sequence
  Description of Artificial Sequence: Synthetic polypeptide
CLGPGKFKCRSGECIDISKVCNQEQDCRDWSDEPLKEC

SEQ ID NO: 778 - protein, 37 aa, Artificial Sequence
  Description of Artificial Sequence: Synthetic polypeptide
CPAEKLSCGPTSHKCVPASWRCDGEKDCEGGADEAGC

SEQ ID NO: 779 - protein, 41 aa, Artificial Sequence
  Description of Artificial Sequence: Synthetic polypeptide
CTHFMDFVCKNRQQCLFHSMVCDGIIQCRDGSDEDAAFAGC

SEQ ID NO: 780 - protein, 40 aa, Artificial Sequence
  Description of Artificial Sequence: Synthetic polypeptide
CAYNQFQCLSRFTKVYTCLPESLKCDGNIDCLDLGDEIDC

SEQ ID NO: 781 - protein, 37 aa, Artificial Sequence
  Description of Artificial Sequence: Synthetic polypeptide
CNPGQFACRSGTIQCIPLPWQCDGWATCEDESDEANC

SEQ ID NO: 782 - protein, 35 aa, Artificial Sequence
  Description of Artificial Sequence: Synthetic polypeptide
CQADEFRCDNGKCLPGPWQCNTVDECGDGSDEGNC

SEQ ID NO: 783 - protein, 38 aa, Artificial Sequence
  Description of Artificial Sequence: Synthetic polypeptide
CPGGTFPCSGARSTRCLPVERRCDGLQDCGDGSDEAGC

SEQ ID NO: 784 - protein, 46 aa, Artificial Sequence
  Description of Artificial Sequence: Synthetic polypeptide
CLPWEQPCGSSSDSDGGSLGDQGCFSEPQRCDGWWHCASGRDEQGC

SEQ ID NO: 785 - protein, 37 aa, Artificial Sequence
  Description of Artificial Sequence: Synthetic polypeptide
CPPDQYPCEGGSGLCYTPADRCNNQKSCPDGADEKNC

SEQ ID NO: 786 - protein, 35 aa, Artificial Sequence
  Description of Artificial Sequence: Synthetic polypeptide
CQPGTFHCGTNLCIFETWRCDGQEDCQDGSDEHGC

SEQ ID NO: 787 - protein, 37 aa, Artificial Sequence
  Description of Artificial Sequence: Synthetic polypeptide
CSPDQFACATGEIDCIPGAWRCDGFPECDDQSDEEGC

SEQ ID NO: 788 - protein, 35 aa, Artificial Sequence
  Description of Artificial Sequence: Synthetic polypeptide
CSAAQFPCARGQCVDLRLRCDGEADCQDRSDEVDC

SEQ ID NO: 789 - protein, 35 aa, Artificial Sequence
  Description of Artificial Sequence: Synthetic polypeptide
CLPNQFRCASGQCVLIKQQCDSFPDCIDGSDELMC

SEQ ID NO: 790 - protein, 37 aa, Artificial Sequence
  Description of Artificial Sequence: Synthetic polypeptide
CSPQQFTCFTGEIDCIPVAWRCDGFTECEDHSDELNC

SEQ ID NO: 791 - protein, 35 aa, Artificial Sequence
  Description of Artificial Sequence: Synthetic polypeptide
CSESQFQCASGQCIDGALRCNGDANCQDKSDEKNC

SEQ ID NO: 792 - protein, 35 aa, Artificial Sequence
  Description of Artificial Sequence: Synthetic polypeptide
CLIDQFRCANGQCIGKHKKCDHNVDCSDKSDELDC

SEQ ID NO: 793 - protein, 35 aa, Artificial Sequence
  Description of Artificial Sequence: Synthetic polypeptide
CACDQFRCGNGKCIPEAWKCNNMDECGDSSDEEIC

SEQ ID NO: 794 - protein, 40 aa, Artificial Sequence; identical to SEQ ID NO: 780
  Description of Artificial Sequence: Synthetic polypeptide

SEQ ID NO: 795 - protein, 36 aa, Artificial Sequence
  Description of Artificial Sequence: Synthetic polypeptide
CLPWEIPCGGNWGCYTEQQRCDGYWHCPNGRDETNC

SEQ ID NO: 796 - protein, 36 aa, Artificial Sequence
  Description of Artificial Sequence: Synthetic polypeptide
CQKEEFPCSRNGVCYPRSDRCNYQNHCPNGSDEKNC

SEQ ID NO: 797 - protein, 35 aa, Artificial Sequence
  Description of Artificial Sequence: Synthetic polypeptide
CQPGNFHCKNNRCVFESWVCDSQDDCGDGSDEENC

SEQ ID NO: 798 - protein, 36 aa, Artificial Sequence
  Description of Artificial Sequence: Synthetic polypeptide
CGRGENFLCASGICIPGKLQCNGYNDCDDWSDEAHC

SEQ ID NO: 799 - protein, 35 aa, Artificial Sequence
  Description of Artificial Sequence: Synthetic polypeptide
CSENLFHCHTGKCLNYSLVCDGYDDCGDLSDEQNC

SEQ ID NO: 800 - protein, 36 aa, Artificial Sequence
  Description of Artificial Sequence: Synthetic polypeptide
CNPTTEHRCGDGRCIAMEWVCDGDHDCVDKSDEVNC

SEQ ID NO: 801 - protein, 36 aa, Artificial Sequence; identical to SEQ ID NO: 773
  Description of Artificial Sequence: Synthetic polypeptide

SEQ ID NO: 802 - protein, 35 aa, Artificial Sequence
  Description of Artificial Sequence: Synthetic polypeptide
CSPSHFKCRSGQCVLASRRCDGQADCDDDSDEENC

SEQ ID NO: 803 - protein, 37 aa, Artificial Sequence
  Description of Artificial Sequence: Synthetic polypeptide
CKERDLWECPSNKQCLKHTVICDGFPDCPDYMDEKNC

SEQ ID NO: 804 - protein, 35 aa, Artificial Sequence
  Description of Artificial Sequence: Synthetic polypeptide
CQDDELECANHACVSRDLWCDGEADCSDSSDEWDC

SEQ ID NO: 805 - protein, 36 aa, Artificial Sequence
  Description of Artificial Sequence: Synthetic polypeptide
CSNSGIECDSSGTCINPSNWCDGVSHCPGGEDENRC

SEQ ID NO: 806 - protein, 35 aa, Artificial Sequence
  Description of Artificial Sequence: Synthetic polypeptide
CSGKYRCRSSFKCIELIARCDGVSDCKDGEDEYRC

SEQ ID NO: 807 - protein, 34 aa, Artificial Sequence
  Description of Artificial Sequence: Synthetic polypeptide
CPGQFTCRTGRCIRKELRCDGWADCTDHSDELNC

SEQ ID NO: 808 - protein, 36 aa, Artificial Sequence
  Description of Artificial Sequence: Synthetic polypeptide
CDAGHQFTCKNKFCKPLFWVCDSVNDCGDNSDEQGC

SEQ ID NO: 809 - protein, 35 aa, Artificial Sequence; identical to SEQ ID NO: 774
  Description of Artificial Sequence: Synthetic polypeptide

SEQ ID NO: 810 - protein, 36 aa, Artificial Sequence; identical to SEQ ID NO: 776
  Description of Artificial Sequence: Synthetic polypeptide

SEQ ID NO: 811 - protein, 38 aa, Artificial Sequence
  Description of Artificial Sequence: Synthetic polypeptide
CLPGSSPCTDALTCIKADLFCDGEVNCPDGSDEDNKMC

SEQ ID NO: 812 - protein, 35 aa, Artificial Sequence
  Description of Artificial Sequence: Synthetic polypeptide
CKADHFQCKNGECVPLVNLCDGHLHCEDGSDEADC

SEQ ID NO: 813 - protein, 35 aa, Artificial Sequence
  Description of Artificial Sequence: Synthetic polypeptide
CQPTQFRCSNGCCIDSFLECDDTPNCPDASDEAAC

SEQ ID NO: 814 - protein, 42 aa, Artificial Sequence
  Description of Artificial Sequence: Synthetic polypeptide
CYTQKADSPMDDFFQCVNGKYISQMKACDGINDCGDQSDELC

SEQ ID NO: 815 - protein, 35 aa, Artificial Sequence
  Description of Artificial Sequence: Synthetic polypeptide
CQGKGFHCKSGVCIPSQYQCNGEVDCITGEDEVGC

SEQ ID NO: 816 - protein, 34 aa, Artificial Sequence
  Description of Artificial Sequence: Synthetic polypeptide
CKNKFRCDSGRCIARKLECNGENDCGDNSDERDC

SEQ ID NO: 817 - protein, 35 aa, Artificial Sequence
  Description of Artificial Sequence: Synthetic polypeptide
CGERFRCFSGQCISKSLVCNGDSDCDEDSADEDRC

SEQ ID NO: 818 - protein, 35 aa, Artificial Sequence
  Description of Artificial Sequence: Synthetic polypeptide
CGQDFQCKETGRCLKRHLVCNGDQDCLDGSDEDDC

SEQ ID NO: 819 - protein, 34 aa, Artificial Sequence; identical to SEQ ID NO: 775
  Description of Artificial Sequence: Synthetic polypeptide

SEQ ID NO: 820 - protein, 34 aa, Artificial Sequence
  Description of Artificial Sequence: Synthetic polypeptide
CGNDFQCSTGRCIKMRLRCNGDNDCGDFSDEDDC

SEQ ID NO: 821 - protein, 36 aa, Artificial Sequence
  Description of Artificial Sequence: Synthetic polypeptide
CTEAEFACHSYNECVALEYRCDRRPDCRDMSDELNC

SEQ ID NO: 822 - protein, 35 aa, Artificial Sequence
  Description of Artificial Sequence: Synthetic polypeptide
CGPQEAACRNGHCIPRDYLCDGQEDCEDGSDELDC

SEQ ID NO: 823 - protein, 35 aa, Artificial Sequence
  Description of Artificial Sequence: Synthetic polypeptide
CEPNEFPCGNGHCALKLWRCDGDFDCEDRTDEANC

SEQ ID NO: 824 - protein, 36 aa, Artificial Sequence
  Description of Artificial Sequence: Synthetic polypeptide
CGPTQFRCVSTNMCIPASFHCDEESDCPDRSDEFGC

SEQ ID NO: 825 - protein, 35 aa, Artificial Sequence
  Description of Artificial Sequence: Synthetic polypeptide
CLRNQYRCSNGNCINSIWWCDFDNDCGDMSDERNC

SEQ ID NO: 826 - protein, 37 aa, Artificial Sequence
  Description of Artificial Sequence: Synthetic polypeptide
CDLDTQFRCQESGTCIPLSYKCDLEDDCGDNSDESHC

SEQ ID NO: 827 - protein, 35 aa, Artificial Sequence
  Description of Artificial Sequence: Synthetic polypeptide
CRSDEYNCSSGMCIRSSWVCDGDNDCRDWSDEANC

SEQ ID NO: 828 - protein, 37 aa, Artificial Sequence
  Description of Artificial Sequence: Synthetic polypeptide
CEASNFQCRNGHCIPQRWACDGDTDCQDGSDEDPVNC

SEQ ID NO: 829 - protein, 33 aa, Artificial Sequence
  Description of Artificial Sequence: Synthetic polypeptide
CNGFRCPNGTCIPSSKHCDGLRDCSDGSDEQHC

SEQ ID NO: 830 - protein, 41 aa, Artificial Sequence; identical to SEQ ID NO: 779
  Description of Artificial Sequence: Synthetic polypeptide

SEQ ID NO: 831 - protein, 35 aa, Artificial Sequence
  Description of Artificial Sequence: Synthetic polypeptide
CDEFGFQCQNGVCISLIWKCDGMDDCGDYSDEANC

SEQ ID NO: 832 - protein, 36 aa, Artificial Sequence
  Description of Artificial Sequence: Synthetic polypeptide
CSRYFQFRCENGHCIPNRWKCDRENDCGDWSDEKDC

SEQ ID NO: 833 - protein, 35 aa, Artificial Sequence
  Description of Artificial Sequence: Synthetic polypeptide
CLPNYYRCSSGTCVMDTWVCDGYRDCADGSDEEAC

SEQ ID NO: 834 - protein, 36 aa, Artificial Sequence
  Description of Artificial Sequence: Synthetic polypeptide
CDRFEFECHQPKTCIPNWKRCDGHQDCQDGRDEANC

SEQ ID NO: 835 - protein, 36 aa, Artificial Sequence
  Description of Artificial Sequence: Synthetic polypeptide
CMSREFQCEDGEACIVLSERCDGFLDCSDESDEKAC

SEQ ID NO: 836 - protein, 35 aa, Artificial Sequence
  Description of Artificial Sequence: Synthetic polypeptide
CEKDQFQCRNERCIPSVWRCDEDDDCLDHSDEDDC

SEQ ID NO: 837 - protein, 37 aa, Artificial Sequence
  Description of Artificial Sequence: Synthetic polypeptide
CADSDFTCDNGHCIHERWKCDGEEECPDGSDESEATC

SEQ ID NO: 838 - protein, 37 aa, Artificial Sequence; identical to SEQ ID NO: 778
  Description of Artificial Sequence: Synthetic polypeptide

SEQ ID NO: 839 - protein, 35 aa, Artificial Sequence
  Description of Artificial Sequence: Synthetic polypeptide
CAPHEFQCGNRSCLAAVFVCDGDDDCGDGSDERGC

SEQ ID NO: 840 - protein, 40 aa, Artificial Sequence
  Description of Artificial Sequence: Synthetic polypeptide
CGPREFRCGGDGGGACIPERWVCDRQFDCEDRSDEAAELC

SEQ ID NO: 841 - protein, 36 aa, Artificial Sequence
  Description of Artificial Sequence: Synthetic polypeptide
CATVSQFACRSGECVHLGWRCDGDRDCKDKSDEADC

SEQ ID NO: 842 - protein, 35 aa, Artificial Sequence
  Description of Artificial Sequence: Synthetic polypeptide
CRGDEFQCGDGTCVLAIKHCNQEQDCPDGSDEAGC

SEQ ID NO: 843 - protein, 37 aa, Artificial Sequence
  Description of Artificial Sequence: Synthetic polypeptide
CERNEFQCQDGKCISYKWVCDGSAECQDGSDESQETC

SEQ ID NO: 844 - protein, 37 aa, Artificial Sequence
  Description of Artificial Sequence: Synthetic polypeptide
CKSGDFSCGGRVNRCIPQFWRCDGQVDCDNGSDEQGC

SEQ ID NO: 845 - protein, 35 aa, Artificial Sequence
  Description of Artificial Sequence: Synthetic polypeptide
CSQDEFRCHDGKCISRQFVCDSDRDCLDGSDEASC

SEQ ID NO: 846 - protein, 37 aa, Artificial Sequence
  Description of Artificial Sequence: Synthetic polypeptide
CGPASFQCNSSTCIPQLWACDNDPDCEDGSDEWPQRC

SEQ ID NO: 847 - protein, 35 aa, Artificial Sequence
  Description of Artificial Sequence: Synthetic polypeptide
CSAFEFHCLSGECIHSSWRCDGGPDCKDKSDEENC

SEQ ID NO: 848 - protein, 35 aa, Artificial Sequence
  Description of Artificial Sequence: Synthetic polypeptide
CRPDEFQCSDGNCIHGSRQCDREYDCKDMSDEVGC

SEQ ID NO: 849 - protein, 38 aa, Artificial Sequence
  Description of Artificial Sequence: Synthetic polypeptide
CEGPNKFKCHSGECITLDKVCNMARDCRDWSDEPIKEC

SEQ ID NO: 850 - protein, 35 aa, Artificial Sequence
  Description of Artificial Sequence: Synthetic polypeptide
CEPSQFQCTNGRCITLLWKCDGDEDCVDGSDEKNC

SEQ ID NO: 851 - protein, 37 aa, Artificial Sequence
  Description of Artificial Sequence: Synthetic polypeptide
CAESDFVCNNGQCVPSRWKCDGDPDCEDGSDESPEQC

SEQ ID NO: 852 - protein, 37 aa, Artificial Sequence
  Description of Artificial Sequence: Synthetic polypeptide
CRIHEISCGAHSTQCIPVSWRCDGENDCDSGEDEENC

SEQ ID NO: 853 - protein, 35 aa, Artificial Sequence
  Description of Artificial Sequence: Synthetic polypeptide
CSPDEFTCSSGRCISRNFVCNGQDDCSDGSDELDC

SEQ ID NO: 854 - protein, 37 aa, Artificial Sequence
  Description of Artificial Sequence: Synthetic polypeptide
CGAHEFQCSTSSCIPISWVCDDDADCSDQSDESLEQC

SEQ ID NO: 855 - protein, 35 aa, Artificial Sequence
  Description of Artificial Sequence: Synthetic polypeptide
CPASEIQCGSGECIHKKWRCDGDPDCKDGSDEVNC

SEQ ID NO: 856 - protein, 35 aa, Artificial Sequence
  Description of Artificial Sequence: Synthetic polypeptide
CRPDQFECEDGSCIHGSRQCNGIRDCVDGSDEVNC

SEQ ID NO: 857 - protein, 38 aa, Artificial Sequence; identical to SEQ ID NO: 777
  Description of Artificial Sequence: Synthetic polypeptide

SEQ ID NO: 858 - protein, 38 aa, Artificial Sequence
  Description of Artificial Sequence: Synthetic polypeptide
CSPKQFACRDQITCISKGWRCDGERDCPDGSDEAPEIC

SEQ ID NO: 859 - protein, 37 aa, Artificial Sequence
  Description of Artificial Sequence: Synthetic polypeptide
CQPNEHNCLGTELCVPMSRLCNGVQDCMDGSDEGPHC

SEQ ID NO: 860 - protein, 37 aa, Artificial Sequence
  Description of Artificial Sequence: Synthetic polypeptide
CQPGEFACANSRCIQERWKCDGDNDCLDNSDEAPALC

SEQ ID NO: 861 - protein, 37 aa, Artificial Sequence
  Description of Artificial Sequence: Synthetic polypeptide
CPSDRFKCENNRCIPNRWLCDGDNDCGNSEDESNATC

SEQ ID NO: 862 - protein, 36 aa, Artificial Sequence
  Description of Artificial Sequence: Synthetic polypeptide
CPPNQFSCASGRCIPISWTCDLDDDCGDRSDESASC

SEQ ID NO: 863 - protein, 36 aa, Artificial Sequence
  Description of Artificial Sequence: Synthetic polypeptide
CFPLTQFTCNNGRCININWRCDNDNDCGDNSDEAGC

SEQ ID NO: 864 - protein, 37 aa, Artificial Sequence
  Description of Artificial Sequence: Synthetic polypeptide
CSSTQFKCNSGRCIPEHWTCDGDNDCGDYSDETHANC

SEQ ID NO: 865 - protein, 36 aa, Artificial Sequence
  Description of Artificial Sequence: Synthetic polypeptide
CHTDEFQCRLDGLCIPLRWRCDGDTDCMDSSDEKSC

SEQ ID NO: 866 - protein, 37 aa, Artificial Sequence
  Description of Artificial Sequence: Synthetic polypeptide
CDPSVKFGCKDSARCISKAWVCDGDNDCEDNSDEENC

SEQ ID NO: 867 - protein, 38 aa, Artificial Sequence
  Description of Artificial Sequence: Synthetic polypeptide
CRPPSHPCANNTSVCLPPDKLCDGNDDCGDGSDEGELC

SEQ ID NO: 868 - protein, 38 aa, Artificial Sequence
  Description of Artificial Sequence: Synthetic polypeptide
CRAQDEFECANGECINFSLTCDGVPHCKDKSDEKPSYC

SEQ ID NO: 869 - protein, 35 aa, Artificial Sequence
  Description of Artificial Sequence: Synthetic polypeptide
CKKTFRQCSNGRCVSNMLWCNGADDCGDGSDEIPC

SEQ ID NO: 870 - protein, 35 aa, Artificial Sequence
  Description of Artificial Sequence: Synthetic polypeptide
CGVGEFRCRDGTCIGNSSRCNQFVDCEDASDEMNC

SEQ ID NO: 871 - protein, 45 aa, Artificial Sequence
  Description of Artificial Sequence: Synthetic polypeptide
CSSYFRLGVKGVLFQPCERTSLCYAPSWVCDGANDCGDYSDERDC

SEQ ID NO: 872 - protein, 35 aa, Artificial Sequence
  Description of Artificial Sequence: Synthetic polypeptide
CPLNYFACPSGRCIPMSWTCDKEDDCEHGEDETHC

SEQ ID NO: 873 - protein, 36 aa, Artificial Sequence
  Description of Artificial Sequence: Synthetic polypeptide
CSEAQFECQNHRCISKQWLCDGSDDCGDGSDEAAHC

SEQ ID NO: 874 - protein, 39 aa, Artificial Sequence
  Description of Artificial Sequence: Synthetic polypeptide
CGPSSFSCPGTHVCVPERWLCDGDKDCADGADESIAAGC

SEQ ID NO: 875 - protein, 36 aa, Artificial Sequence
  Description of Artificial Sequence: Synthetic polypeptide
CDDREFMCQNRQCIPKHFVCDHDRDCADGSDESPEC

SEQ ID NO: 876 - protein, 40 aa, Artificial Sequence
  Description of Artificial Sequence: Synthetic polypeptide
CGPSEFRCANGRCLSSRQWECDGENDCHDQSDEAPKNPHC

SEQ ID NO: 877 - protein, 36 aa, Artificial Sequence
  Description of Artificial Sequence: Synthetic polypeptide
CNASSQFLCSSGRCVAEALLCNGQDDCGDSSDERGC

SEQ ID NO: 878 - protein, 36 aa, Artificial Sequence
  Description of Artificial Sequence: Synthetic polypeptide
CTASQFVCKNDKCIPFWWKCDTEDDCGDHSDEPPDC

SEQ ID NO: 879 - protein, 35 aa, Artificial Sequence
  Description of Artificial Sequence: Synthetic polypeptide
CRPGQFQCSTGICTNPAFICDGDNDCQDNSDEANC

SEQ ID NO: 880 - protein, 36 aa, Artificial Sequence
  Description of Artificial Sequence: Synthetic polypeptide
CLPSQFKCTNTNRCIPGIFRCNGQDNCGDGEDERDC

SEQ ID NO: 881 - protein, 37 aa, Artificial Sequence
  Description of Artificial Sequence: Synthetic polypeptide
CAPNQFQCSITKRCIPRVWVCDRDNDCVDGSDEPANC

SEQ ID NO: 882 - protein, 38 aa, Artificial Sequence
  Description of Artificial Sequence: Synthetic polypeptide
CGVDEFRCKDSGRCIPARWKCDGEDDCGDGSDEPKEEC

SEQ ID NO: 883 - protein, 35 aa, Artificial Sequence; identical to SEQ ID NO: 768
  Description of Artificial Sequence: Synthetic polypeptide

SEQ ID NO: 884 - protein, 35 aa, Artificial Sequence
  Description of Artificial Sequence: Synthetic polypeptide
CSESEFSCANGRCIAGRWKCDGDHDCADGSDEKDC

SEQ ID NO: 885 - protein, 35 aa, Artificial Sequence
  Description of Artificial Sequence: Synthetic polypeptide
CDMDQFQCKSGHCIPLRWRCDADADCMDGSDEEAC

SEQ ID NO: 886 - protein, 37 aa, Artificial Sequence
  Description of Artificial Sequence: Synthetic polypeptide
CPLDEFQCNNTLCKPLAWKCDGEDDCGDNSDENPEEC

SEQ ID NO: 887 - protein, 37 aa, Artificial Sequence
  Description of Artificial Sequence: Synthetic polypeptide
CPPNRPFRCKNDRVCLWIGRQCDGTDNCGDGTDEEDC

SEQ ID NO: 888 - protein, 36 aa, Artificial Sequence
  Description of Artificial Sequence: Synthetic polypeptide
CKDKKEFLCRNQRCLSSSLRCNMFDDCGDGSDEEDC

SEQ ID NO: 889 - protein, 35 aa, Artificial Sequence
  Description of Artificial Sequence: Synthetic polypeptide
CDSAHFRCGSGHCIPADWRCDGTKDCSDDADEIGC

SEQ ID NO: 890 - protein, 37 aa, Artificial Sequence
  Description of Artificial Sequence: Synthetic polypeptide
CQQGYFKCQSEGQCIPSSWVCDQDQDCDDGSDERQDC

SEQ ID NO: 891 - protein, 35 aa, Artificial Sequence
  Description of Artificial Sequence: Synthetic polypeptide
CSSHQITCSNGQCIPSEYRCDHVRDCPDGADENDC

SEQ ID NO: 892 - protein, 33 aa, Artificial Sequence
  Description of Artificial Sequence: Synthetic polypeptide
CEQLTCDNGACYNTSQKCDWKVDCRDSSDEINC

SEQ ID NO: 893 - protein, 35 aa, Artificial Sequence
  Description of Artificial Sequence: Synthetic polypeptide
CLHNEFSCGNGECIPRAYVCDHDNDCQDGSDEHAC

SEQ ID NO: 894 - protein, 35 aa, Artificial Sequence
  Description of Artificial Sequence: Synthetic polypeptide
CGGYQFTCPSGRCIYQNWVCDGEDDCKDNGDEDGC

SEQ ID NO: 895 - protein, 42 aa, Artificial Sequence
  Description of Artificial Sequence: Synthetic polypeptide
CSPREWSCPESGRCISIYKVCDGILDCPGREDENNTSTGKYC

SEQ ID NO: 896 - protein, 35 aa, Artificial Sequence
  Description of Artificial Sequence: Synthetic polypeptide
CGLFSFPCKNGRCVPNYYLCDGVDDCHDNSDEQLC

SEQ ID NO: 897 - protein, 35 aa, Artificial Sequence
  Description of Artificial Sequence: Synthetic polypeptide
CSSSAFTCGHGECIPAHWRCDKRNDCVDGSDEHNC

SEQ ID NO: 898 - protein, 35 aa, Artificial Sequence
  Description of Artificial Sequence: Synthetic polypeptide
CLDTQYTCDNHQCISKNWVCDTDNDCGDGSDEKNC

SEQ ID NO: 899 - protein, 35 aa, Artificial Sequence
  Description of Artificial Sequence: Synthetic polypeptide
CQPSQFNCPNHRCIDLSFVCDGDKDCVDGSDEVGC

SEQ ID NO: 900 - protein, 36 aa, Artificial Sequence
  Description of Artificial Sequence: Synthetic polypeptide
CTASQFKCASGDKCIGVTNRCDGVFDCSDNSDEAGC

SEQ ID NO: 901 - protein, 37 aa, Artificial Sequence
  Description of Artificial Sequence: Synthetic polypeptide
CHSDEFQCQEDGICIPNFWECDGHPDCLYGSDEHNAC

SEQ ID NO: 902 - protein, 35 aa, Artificial Sequence
  Description of Artificial Sequence: Synthetic polypeptide
CPSSYFHCDNGNCIHRAWLCDRDNDCGDMSDEKDC

SEQ ID NO: 903 - protein, 37 aa, Artificial Sequence
  Description of Artificial Sequence: Synthetic polypeptide
CPSWQWQCLGHNICVNLSVVCDGIFDCPNGTDESPLC

SEQ ID NO: 904 - protein, 37 aa, Artificial Sequence
  Description of Artificial Sequence: Synthetic polypeptide
CGASSFTCSNGRCISEEWKCDNDNDCGDGSDEMESVC

SEQ ID NO: 905 - protein, 35 aa, Artificial Sequence
  Description of Artificial Sequence: Synthetic polypeptide
CSPTAFTCANGRCVQYSYRCDYYNDCGDGSDEAGC

SEQ ID NO: 906 - protein, 38 aa, Artificial Sequence
  Description of Artificial Sequence: Synthetic polypeptide
CNATTEFMCNNRRCIPREFICNGVDNCHDNNTSDEKNC

SEQ ID NO: 907 - protein, 38 aa, Artificial Sequence
  Description of Artificial Sequence: Synthetic polypeptide
CQSGYTKCHNSNICIPRVYLCDGDNDCGDNSDENPTYC

SEQ ID NO: 908 - protein, 36 aa, Artificial Sequence; identical to SEQ ID NO: 772
  Description of Artificial Sequence: Synthetic polypeptide

SEQ ID NO: 909 - protein, 38 aa, Artificial Sequence
  Description of Artificial Sequence: Synthetic polypeptide
CLADEFKCDGGRCIPSEWICDGDNDCGDMSDEDKRHQC

SEQ ID NO: 910 - protein, 41 aa, Artificial Sequence
  Description of Artificial Sequence: Synthetic polypeptide
CSDSEFLCVNDRPPDRRCIPQSWVCDGDVDCTDGYDENQNC

SEQ ID NO: 911 - protein, 35 aa, Artificial Sequence
  Description of Artificial Sequence: Synthetic polypeptide
CSENEFTCGYGLCIPKIFRCDRHNDCGDYSDERGC

SEQ ID NO: 912 - protein, 37 aa, Artificial Sequence
  Description of Artificial Sequence: Synthetic polypeptide
CQQNQFTCQNGRCISKTFVCDEDNDCGDGSDELMHLC

SEQ ID NO: 913 - protein, 35 aa, Artificial Sequence
  Description of Artificial Sequence: Synthetic polypeptide
CPPHEFKCDNGRCIEMMKLCNHLDDCLDNSDEKGC

SEQ ID NO: 914 - protein, 37 aa, Artificial Sequence
  Description of Artificial Sequence: Synthetic polypeptide
CSSTQFLCANNEKCIPIWWKCDGQKDCSDGSDELALC

SEQ ID NO: 915 - protein, 37 aa, Artificial Sequence
  Description of Artificial Sequence: Synthetic polypeptide
CRLGQFQCSDGNCTSPQTLCNAHQNCPDGSDEDRLLC

SEQ ID NO: 916 - protein, 37 aa, Artificial Sequence
  Description of Artificial Sequence: Synthetic polypeptide
CDSNEWQCANKRCIPESWQCDTFNDCEDNSDEDSSHC

SEQ ID NO: 917 - protein, 37 aa, Artificial Sequence
  Description of Artificial Sequence: Synthetic polypeptide
CRPGQFRCANGRCIPQAWKCDVDNDCGDHSDEPIEEC

SEQ ID NO: 918 - protein, 37 aa, Artificial Sequence
  Description of Artificial Sequence: Synthetic polypeptide
CDNFTEFSCKTNYRCIPKWAVCNGVDDCRDNSDEQGC

SEQ ID NO: 919 - protein, 36 aa, Artificial Sequence
  Description of Artificial Sequence: Synthetic polypeptide
CHPVGDFRCKNHHCIPLRWQCDGQNDCGDNSDEENC

SEQ ID NO: 920 - protein, 35 aa, Artificial Sequence
  Description of Artificial Sequence: Synthetic polypeptide
CTESEFRCVNQQCIPSRWICDHYNDCGDNSDERDC

SEQ ID NO: 921 - protein, 35 aa, Artificial Sequence
  Description of Artificial Sequence: Synthetic polypeptide
CHPEYFQCTSGHCVHSELKCDGSADCLDASDEADC

SEQ ID NO: 922 - protein, 37 aa, Artificial Sequence
  Description of Artificial Sequence: Synthetic polypeptide
CQATMFECKNHVCIPPYWKCDGDDDCGDGSDEELHLC

SEQ ID NO: 923 - protein, 38 aa, Artificial Sequence
  Description of Artificial Sequence: Synthetic polypeptide
CNSPNRFRCDNNRCIYSHEVCNGVDDCGDGTDETEEHC

SEQ ID NO: 924 - protein, 35 aa, Artificial Sequence
  Description of Artificial Sequence: Synthetic polypeptide
CTEYEYKCGNGHCIPHDNVCDDADDCGDWSDELGC

SEQ ID NO: 925 - protein, 38 aa, Artificial Sequence
  Description of Artificial Sequence: Synthetic polypeptide
CDPGEFLCHDHVTCVSQSWLCDGDPDCPDDSDESLDTC

SEQ ID NO: 926 - protein, 37 aa, Artificial Sequence
  Description of Artificial Sequence: Synthetic polypeptide
CPLNHIACLGTNKCVHLSQLCNGVLDCPDGYDEGVHC

SEQ ID NO: 927 - protein, 37 aa, Artificial Sequence
  Description of Artificial Sequence: Synthetic polypeptide
CKAGEFRCKNRHCIQARWKCDGDDDCLDGSDEDSVNC

SEQ ID NO: 928 - protein, 37 aa, Artificial Sequence
  Description of Artificial Sequence: Synthetic polypeptide
CPDDQFKCQNNRCIPKRWLCDGANDCGSNEDESNQTC

SEQ ID NO: 929 - protein, 36 aa, Artificial Sequence
  Description of Artificial Sequence: Synthetic polypeptide
CQVDQFSCGNGRCIPRAWLCDREDDCGDQTDEMASC

SEQ ID NO: 930 - protein, 36 aa, Artificial Sequence
  Description of Artificial Sequence: Synthetic polypeptide
CEPLTQFVCKSGRCISSKWHCDSDDDCGDGSDEVGC

SEQ ID NO: 931 - protein, 37 aa, Artificial Sequence
  Description of Artificial Sequence: Synthetic polypeptide
CFDNQFRCSSGRCIPGHWACDGDNDCGDFSDEAQINC

SEQ ID NO: 932 - protein, 36 aa, Artificial Sequence
  Description of Artificial Sequence: Synthetic polypeptide
CNGNEFQCHPDGNCVPDLWRCDGEKDCEDGSDEKGC

SEQ ID NO: 933 - protein, 37 aa, Artificial Sequence
  Description of Artificial Sequence: Synthetic polypeptide
CDHKTKFSCWSTGRCINKAWVCDGDIDCEDQSDEDDC

SEQ ID NO: 934 - protein, 38 aa, Artificial Sequence
  Description of Artificial Sequence: Synthetic polypeptide
CGPPKHPCANDTSVCLQPEKLCNGKKDCPDGSDEGYLC

SEQ ID NO: 935 - protein, 38 aa, Artificial Sequence
  Description of Artificial Sequence: Synthetic polypeptide
CNAYSEFECGNGECIDYQLTCDGIPHCKDKSDEKLLYC

SEQ ID NO: 936 - protein, 35 aa, Artificial Sequence
  Description of Artificial Sequence: Synthetic polypeptide
CRRGFKPCYNRRCIPHGKLCDGENDCGDNSDELDC

SEQ ID NO: 937 - protein, 35 aa, Artificial Sequence
  Description of Artificial Sequence: Synthetic polypeptide
CATVEFRCADGTCIPRSARCNQNIDCADASDEKNC

SEQ ID NO: 938 - protein, 45 aa, Artificial Sequence
  Description of Artificial Sequence: Synthetic polypeptide
CTHFYKLGVKTTGFIRCNSTSLCVLPTWICDGSNDCGDYSDELKC

SEQ ID NO: 939 - protein, 35 aa, Artificial Sequence
  Description of Artificial Sequence: Synthetic polypeptide
CEENYFSCPSGRCILNTWICDGQKDCEDGRDEFHC

SEQ ID NO: 940 - protein, 37 aa, Artificial Sequence
  Description of Artificial Sequence: Synthetic polypeptide
CSWNQFACSAQKCISKHWICDGEDDCGDGLDESDSIC

SEQ ID NO: 941 - protein, 39 aa, Artificial Sequence
  Description of Artificial Sequence: Synthetic polypeptide
CAADMFSCQGSRACVPRHWLCDGERDCPDGSDELSTAGC

SEQ ID NO: 942 - protein, 36 aa, Artificial Sequence
  Description of Artificial Sequence: Synthetic polypeptide
CDENAFMCHNKVCIPKQFVCDHDDDCGDGSDESPQC

SEQ ID NO: 943 - protein, 40 aa, Artificial Sequence
  Description of Artificial Sequence: Synthetic polypeptide
CGTEEFSCADGRCLLNTQWQCDGDFDCPDHSDEAPLNPKC

SEQ ID NO: 944 - protein, 35 aa, Artificial Sequence
  Description of Artificial Sequence: Synthetic polypeptide
CNSSFFMCKNGRCIPSGGLCDNKDDCGDGSDERNC

SEQ ID NO: 945 - protein, 36 aa, Artificial Sequence
  Description of Artificial Sequence: Synthetic polypeptide
CTASQFRCKTDKCIPFWWKCDTVDDCGDGSDEPDDC

SEQ ID NO: 946 - protein, 35 aa, Artificial Sequence
  Description of Artificial Sequence: Synthetic polypeptide
CQPGRFQCGTGLCALPAFICDGENDCGDNSDELNC

SEQ ID NO: 947 - protein, 36 aa, Artificial Sequence
  Description of Artificial Sequence: Synthetic polypeptide
CLSGQFKCTKNQKCIPVNLRCNGQDDCGDEEDERDC

SEQ ID NO: 948 - protein, 36 aa, Artificial Sequence
  Description of Artificial Sequence: Synthetic polypeptide
CSPDYFQCKTTKHCISKLWVCDEDPDCADASDEANC

SEQ ID NO: 949 - protein, 35 aa, Artificial Sequence
  Description of Artificial Sequence: Synthetic polypeptide
CGPHEFQCKNNNCIPDHWRCDSQNDCSDNSDEENC

SEQ ID NO: 950 - protein, 35 aa, Artificial Sequence
  Description of Artificial Sequence: Synthetic polypeptide
CTLKDFLCANGDCVSSRFWCDGDFDCADGSDERNC

SEQ ID NO: 951 - protein, 35 aa, Artificial Sequence
  Description of Artificial Sequence: Synthetic polypeptide
CSKDQFRCSNGQCIPAKWKCDGHEDCKYGEDEKSC

SEQ ID NO: 952 - protein, 35 aa, Artificial Sequence
  Description of Artificial Sequence: Synthetic polypeptide
CSSREYICASDGCISASLKCNGEYDCADGSDEMDC

SEQ ID NO: 953 - protein, 36 aa, Artificial Sequence
  Description of Artificial Sequence: Synthetic polypeptide
CKEDQFRCKNKAHCIPIRWLCDGIHDCVDGSDEENC

SEQ ID NO: 954 - protein, 37 aa, Artificial Sequence
  Description of Artificial Sequence: Synthetic polypeptide
CRADEFLCNNSLCKLHFWVCDGEDDCGDNSDEAPDMC

SEQ ID NO: 955 - protein, 37 aa, Artificial Sequence
  Description of Artificial Sequence: Synthetic polypeptide
CPSTRPHRCRNNRICLQSEQMCNGIDECGDNSDEDHC

SEQ ID NO: 956 - protein, 35 aa, Artificial Sequence
  Description of Artificial Sequence: Synthetic polypeptide
CKKDEFACSNKKCIPMDLQCDRLDDCGDGSDEQGC

SEQ ID NO: 957 - protein, 37 aa, Artificial Sequence
  Description of Artificial Sequence: Synthetic polypeptide
CAEGEALCQENGHCVPHGWLCDNQDDCGDGSDEEGEC

SEQ ID NO: 958 - protein, 37 aa, Artificial Sequence
  Description of Artificial Sequence: Synthetic polypeptide
CGEGQMTCSSGHCLPLALLCDRQDDCGDGTDEPSYPC

SEQ ID NO: 959 - protein, 35 aa, Artificial Sequence
  Description of Artificial Sequence: Synthetic polypeptide
CPQGLLACADGRCLPPALLCDGHPDCLDAADEESC

SEQ ID NO: 960 - protein, 37 aa, Artificial Sequence
  Description of Artificial Sequence: Synthetic polypeptide
CVPGEVSCVDGTCLGAIQLCDGVWDCPDGADEGPGHC

SEQ ID NO: 961 - protein, 35 aa, Artificial Sequence
  Description of Artificial Sequence: Synthetic polypeptide
CGPFEFRCGSGECTPRGWRCDQEEDCADGSDERGC

SEQ ID NO: 962 - protein, 38 aa, Artificial Sequence
  Description of Artificial Sequence: Synthetic polypeptide
CAPHHAPCARGPHCVSPEQLCDGVRQCPDGSDEGPDAC

SEQ ID NO: 963 - protein, 36 aa, Artificial Sequence
  Description of Artificial Sequence: Synthetic polypeptide
CPGLFPCGVAPGLCLTPEQLCDGIPDCPQGEDELDC

SEQ ID NO: 964 - protein, 39 aa, Artificial Sequence
  Description of Artificial Sequence: Synthetic polypeptide
CPEYTCPNGTCIGFQLVCDGQPDCGRPGQVGPSPEEQGC

SEQ ID NO: 965 - protein, 36 aa, Artificial Sequence
  Description of Artificial Sequence: Synthetic polypeptide
CEPGVGLRCASGECVLRGGPCDGVLDCEDGSDEEGC

SEQ ID NO: 966 - protein, 35 aa, Artificial Sequence
  Description of Artificial Sequence: Synthetic polypeptide
CGPGQTPCEVLGCVEQAQVCDGREDCLDGSDERHC

SEQ ID NO: 967 - protein, 33 aa, Artificial Sequence
  Description of Artificial Sequence: Synthetic polypeptide
CKFTCTSGKCLYLGSLVCNQQNDCGDNSDEENC

SEQ ID NO: 968 - protein, 36 aa, Artificial Sequence
  Description of Artificial Sequence: Synthetic polypeptide
CPPTKFQCRTSGLCVPLTWRCDRDLDCSDGSDEEEC

SEQ ID NO: 969 - protein, 36 aa, Artificial Sequence
  Description of Artificial Sequence: Synthetic polypeptide
CLAGELRCTLSDDCIPLTWRCDGHPDCPDSSDELGC

SEQ ID NO: 970 - protein, 36 aa, Artificial Sequence
  Description of Artificial Sequence: Synthetic polypeptide
CSLGYFPCGNITKCLPQLLHCNGVDDCGNQADEDNC

SEQ ID NO: 971 - protein, 35 aa, Artificial Sequence
  Description of Artificial Sequence: Synthetic polypeptide
CAHDEFRCDQLICLLPDSVCDGFANCADGSDETNC

SEQ ID NO: 972 - protein, 34 aa, Artificial Sequence
  Description of Artificial Sequence: Synthetic polypeptide
CGPSELSCQAGGCKGVQWMCDMWRDCTDGSDDNC

SEQ ID NO: 973 - protein, 35 aa, Artificial Sequence
  Description of Artificial Sequence: Synthetic polypeptide
CSRYHFFCDDGCCIDITLACDGVQQCPDGSDEDFC

SEQ ID NO: 974 - protein, 32 aa, Artificial Sequence
  Description of Artificial Sequence: Synthetic polypeptide
CPGEFLCSVNGLCVPACDGVKDCPNGLDERNC

SEQ ID NO: 975 - protein, 35 aa, Artificial Sequence
  Description of Artificial Sequence: Synthetic polypeptide
CRATFQCKEDSTCISLPKVCDGQPDCLNGSDEEQC

SEQ ID NO: 976 - protein, 36 aa, Artificial Sequence
  Description of Artificial Sequence: Synthetic polypeptide
CGTFTFQCEDRSCVKKPNPQCDGRPDCRDGSDEEHC

SEQ ID NO: 977 - protein, 36 aa, Artificial Sequence
  Description of Artificial Sequence: Synthetic polypeptide
CQKGYFPCGNLTKCLPRAFHCDGKDDCGNGADEENC

SEQ ID NO: 978 - protein, 35 aa, Artificial Sequence
  Description of Artificial Sequence: Synthetic polypeptide
CSTARYHCKNGLCIDKSFICDGQNNCQDNSDEESC

SEQ ID NO: 979 - protein, 36 aa, Artificial Sequence
  Description of Artificial Sequence: Synthetic polypeptide
CGPTFFPCASGIHCIIGRFRCNGFEDCPDGSDEENC

SEQ ID NO: 980 - protein, 36 aa, Artificial Sequence
  Description of Artificial Sequence: Synthetic polypeptide
CNIPGNFMCSNGRCIPGAWQCDGLPDCFDKSDEKEC

SEQ ID NO: 981 - protein, 38 aa, Artificial Sequence
  Description of Artificial Sequence: Synthetic polypeptide
CALDQFLCWNGRCIGQRKLCNGVNDCGDNSDESPQQNC

SEQ ID NO: 982 - protein, 34 aa, Artificial Sequence
  Description of Artificial Sequence: Synthetic polypeptide
CEEDEFPCQNGYCIRSLWHCDGDNDCGDNSDEQC

SEQ ID NO: 983 - protein, 35 aa, Artificial Sequence
  Description of Artificial Sequence: Synthetic polypeptide
CRSGEFMCDSGLCINAGWRCDGDADCDDQSDERNC

SEQ ID NO: 984 - protein, 35 aa, Artificial Sequence
  Description of Artificial Sequence: Synthetic polypeptide
CTAEQFRCHSGRCVRLSWRCDGEDDCADNSDEENC

SEQ ID NO: 985 - protein, 35 aa, Artificial Sequence
  Description of Artificial Sequence: Synthetic polypeptide
CSPLDFHCDNGKCIRRSWVCDGDNDCEDDSDEQDC

SEQ ID NO: 986 - protein, 35 aa, Artificial Sequence
  Description of Artificial Sequence: Synthetic polypeptide
CNLEEFQCAYGRCILDIYHCDGDDDCGDWSDESDC

SEQ ID NO: 987 - protein, 35 aa, Artificial Sequence
  Description of Artificial Sequence: Synthetic polypeptide
CSDKEFRCSDGSCIAEHWYCDGDTDCKDGSDEENC

SEQ ID NO: 988 - protein, 40 aa, Artificial Sequence
  Description of Artificial Sequence: Synthetic polypeptide
CGRSHFTCAVSALGECTCIPAQWQCDGDNDCGDHSDEDGC

SEQ ID NO: 989 - protein, 35 aa, Artificial Sequence
  Description of Artificial Sequence: Synthetic polypeptide
CLQEEFQCLNHRCVSAVQRCDGVDACGDGSDEAGC

SEQ ID NO: 990 - protein, 41 aa, Artificial Sequence
  Description of Artificial Sequence: Synthetic polypeptide
CPPGHFPCGAAGTSGATACYLPADRCNYQTFCADGADERRC

SEQ ID NO: 991 - protein, 35 aa, Artificial Sequence
  Description of Artificial Sequence: Synthetic polypeptide
CQPGNFRCRDEKCVYETWVCDGQPDCADGSDEWDC

SEQ ID NO: 992 - protein, 36 aa, Artificial Sequence
  Description of Artificial Sequence: Synthetic polypeptide
CPEITDFLCRDKKCIASHLLCDYKPDCSDRSDEAHC

SEQ ID NO: 993 - protein, 36 aa, Artificial Sequence
  Description of Artificial Sequence: Synthetic polypeptide
CNNRTFKCGNDICFRKQNAKCDGTVDCPDGSDEEGC

SEQ ID NO: 994 - protein, 37 aa, Artificial Sequence
  Description of Artificial Sequence: Synthetic polypeptide
CPPGHHHCQNKVCVEPQQLCDGEDNCGDLSDENPLTC

SEQ ID NO: 995 - protein, 34 aa, Artificial Sequence
  Description of Artificial Sequence: Synthetic polypeptide
CKQGHLACGDLCVPPEQLCDFEEQCAGGEDEQAC

SEQ ID NO: 996 - protein, 36 aa, Artificial Sequence
  Description of Artificial Sequence: Synthetic polypeptide
CPGNSFSCGNSQCVTKVNPECDDQEDCSDGSDEAHC

SEQ ID NO: 997 - protein, 68 aa, Artificial Sequence
  Description of Artificial Sequence: Synthetic polypeptide
CASGQFQCSNGNCVPQHWVCDGDNDCEDNSDEEDCGDSHILPFSTPGPSTSLQKASGALEHHHHHHHH

SEQ ID NO: 998 - protein, 67 aa, Artificial Sequence
  Description of Artificial Sequence: Synthetic polypeptide
CASGQFTCRSTNICLSLAWLCDGDDDCEDNSDESPAICSAPASEPPGSLSLQKASGALEHHHHHHHH

SEQ ID NO: 999 - protein, 65 aa, Artificial Sequence
  Description of Artificial Sequence: Synthetic polypeptide
CGAGLFTCRSTKICISQAWVCDGVDDCEDNSDEKNCSAPASEPPGSLSLQKASGALEHHHHHHHH

SEQ ID NO: 1000 - protein, 65 aa, Artificial Sequence
  Description of Artificial Sequence: Synthetic polypeptide
CRSRQFQCKGSSTCIPVQWVCDGDNDCGDSSDEAGCSAPASEPPGSLSLQKASGALEHHHHHHHH

SEQ ID NO: 1001 - protein, 65 aa, Artificial Sequence
  Description of Artificial Sequence: Synthetic polypeptide
CGAGQFQCRSTNICISLKWVCDGVDDCEDNSDETSCSAPASEPPGSLSLQKASGALEHHHHHHHH

SEQ ID NO: 1002 - protein, 58 aa, Artificial Sequence
  Description of Artificial Sequence: Synthetic polypeptide
CGAGQFQCRSTNICVSLAWRCDGEDDCEDNSDETSCATHTSLQKASGALEHHHHHHHH

SEQ ID NO: 1003 - protein, 65 aa, Artificial Sequence
  Description of Artificial Sequence: Synthetic polypeptide
CGAGQFTCNSTNICISPRWVCDGVNDCEDNSDEKNCSAPASEPPGSLSLQKASGALEHHHHHHHH

SEQ ID NO: 1004 - protein, 63 aa, Artificial Sequence
  Description of Artificial Sequence: Synthetic polypeptide
CGAGQFTCRDTNICISRAWRCDGVDDCEDNSDEADCSQDPEFHKVSLQKASGALEHHHHHHHH

SEQ ID NO: 1005 - protein, 69 aa, Artificial Sequence
  Description of Artificial Sequence: Synthetic polypeptide
CGAGQFTCRSTKICISQAWVCDGVDDCEDNSDEAGCGDSHILPFSTPGPSTSLQKASGALEHHHHHHHH

SEQ ID NO: 1006 - protein, 65 aa, Artificial Sequence
  Description of Artificial Sequence: Synthetic polypeptide
CGAGQFTCRSTKICISQAWVCDGVDDCEDNSDEKNCSAPASELPGSLSLQKASGALEHHHHHHHH

SEQ ID NO: 1007 - protein, 65 aa, Artificial Sequence
  Description of Artificial Sequence: Synthetic polypeptide
CGAGQFTCRSTKICISQAWVCDGVDDCEDNSDETSCSAPASEPPGSLSLQKASGALEHHHHHHHH

SEQ ID NO: 1008 - protein, 69 aa, Artificial Sequence
  Description of Artificial Sequence: Synthetic polypeptide
CGAGQFTCRSTNICLPLQWVCDGVDDCEDNSDEAGCGDSHILPFSTPGPSTSLQKASGALEHHHHHHHH

SEQ ID NO: 1009 - protein, 69 aa, Artificial Sequence
  Description of Artificial Sequence: Synthetic polypeptide
CGANQFTCHNTNICISLTWVCDGVDDCEDGSDESPDHCGRPGPGATSAPAASLQKASGALEHHHHHHHH

SEQ ID NO: 1010 - protein, 69 aa, Artificial Sequence
  Description of Artificial Sequence: Synthetic polypeptide
CGANQFTCHNTNICISLTWVCDGVDDCEDNSDEAGCGDSHILPFSTPGPSTSLQKASGALEHHHHHHHH

SEQ ID NO: 1011 - protein, 65 aa, Artificial Sequence
  Description of Artificial Sequence: Synthetic polypeptide
CGANQFTCHNTNICISQAWVCDGVDDCEDNSDEKNCSAPASEPPGSLSLQKASGALEHHHHHHHH

SEQ ID NO: 1012 - protein, 65 aa, Artificial Sequence
  Description of Artificial Sequence: Synthetic polypeptide
CGARQFPCRGSRICISQPWVCDGDNDCEDNSDEKNCSAPASEPPGSLSLQKASGALEHHHHHHHH

SEQ ID NO: 1013 - protein, 65 aa, Artificial Sequence
  Description of Artificial Sequence: Synthetic polypeptide
CGPGQFTCQDTEICISQAWVCDGVDDCEDNSDEKNCSAPASEPPGSLSLQKASGALEHHHHHHHH

SEQ ID NO: 1014 - protein, 67 aa, Artificial Sequence
  Description of Artificial Sequence: Synthetic polypeptide
CGPIQFTCRNTNICLSVHWVCDGEDDCEDGSDEEGCGRPGPGATSAPAASLQKASGALEHHHHHHHH

SEQ ID NO: 1015 - protein, 67 aa, Artificial Sequence
  Description of Artificial Sequence: Synthetic polypeptide
CGPNQFTCRSTNICLSQTWVCDGVDDCEDGSDETNCGRPGPGATSAPAASLQKASGALEHHHHHHHH

SEQ ID NO: 1016 - protein, 60 aa, Artificial Sequence
  Description of Artificial Sequence: Synthetic polypeptide
CGPSQFTCRNTNICISLRWRCDGVDDCEDNSDEEGCGTTGPTSLQKASGALEHHHHHHHH

SEQ ID NO: 1017 - protein, 63 aa, Artificial Sequence
  Description of Artificial Sequence: Synthetic polypeptide
CGSNQFTCRSTNICISQAWVCDGVDDCEDDSDETGCSQDPEFHKVSLQKASGALEHHHHHHHH

SEQ ID NO: 1018 - protein, 69 aa, Artificial Sequence
  Description of Artificial Sequence: Synthetic polypeptide
CGSSEFQCRNSRRCIPPAWVCDGDNDCGDSSDEKSCGDSHILPFSTPGPSTSLQKASGALEHHHHHHHH

SEQ ID NO: 1019 - protein, 65 aa, Artificial Sequence
  Description of Artificial Sequence: Synthetic polypeptide
CGSSQFTCHNTNICLPQAWVCDGVDDCEDNSDEKNCSAPASEPPGSLSLQKASGALEHHHHHHHH

SEQ ID NO: 1020 - protein, 69 aa, Artificial Sequence
  Description of Artificial Sequence: Synthetic polypeptide
CGSSQFTCHNTNICLPRARVCDGVDDCEDNSDEAGCGDSHILPFSTPGPSTSLQKASGALEHHHHHHHH

SEQ ID NO: 1021 - protein, 69 aa, Artificial Sequence
  Description of Artificial Sequence: Synthetic polypeptide
CGSSQFTCHNTNICLPRAWVCDGVDDCEDNSDEAGCGDSHILPFSTPGPSTSLQKASGALEHHHHHHHH

SEQ ID NO: 1022 - protein, 65 aa, Artificial Sequence
  Description of Artificial Sequence: Synthetic polypeptide
CGSSQFTCHNTNICLPRAWVCDGVDDCEDNSDEKNCSAPASEPPGSLSLQKASGALEHHHHHHHH

SEQ ID NO: 1023 - protein, 65 aa, Artificial Sequence
  Description of Artificial Sequence: Synthetic polypeptide
CGTGQFTCRSTKICISQAWVCDGVDDCEDNSDEKNCSAPASEPPGSLSLQKASGALEHHHHHHHH

SEQ ID NO: 1024 - protein, 65 aa, Artificial Sequence
  Description of Artificial Sequence: Synthetic polypeptide
CLSDQFTCRSTNICLPLQWVCDGDDDCEDNSDEEDCSAPASEPPGSLSLQKASGALEHHHHHHHH

SEQ ID NO: 1025 - protein, 63 aa, Artificial Sequence
  Description of Artificial Sequence: Synthetic polypeptide
CQSNEFQCRSTGRCISVAWVCDGEDDCRDSSDEADCSQDPEFHKVSLQKASGALEHHHHHHHH

SEQ ID NO: 1026 - protein, 57 aa, Artificial Sequence
  Description of Artificial Sequence: Synthetic polypeptide
CRLNEFPCGSGSCISLHWVCDSVPDCRDDSDETDCPERTSLQKASGALEHHHHHHHH

SEQ ID NO: 1027 - protein, 61 aa, Artificial Sequence
  Description of Artificial Sequence: Synthetic polypeptide
CVPGQFQCNNGNCIPVTWLCDGDNDCGDSSDEAPAHCETSGPTSLQKASGALEHHHHHHHH

SEQ ID NO: 1028 - protein, 57 aa, Artificial Sequence
  Description of Artificial Sequence: Synthetic polypeptide
CVSGQFQCGNGNCIPQAWLCDGDNDCGDSSDEKDCTTRTSLQKASGALEHHHHHHHH

SEQ ID NO: 1029 - protein, 68 aa, Artificial Sequence
  Description of Artificial Sequence: Synthetic polypeptide
CVSGQFQCGNGNCIPRPWRCDGDNDCGDSSDETGCGDSHILPFSTPGPSTSLQKASGALEHHHHHHHH

SEQ ID NO: 1030 - protein, 64 aa, Artificial Sequence
  Description of Artificial Sequence: Synthetic polypeptide
CLPDEFQCGSGRCIPQTWVCDGLNDCGDGSDESPAHCSQDPEFHKVSLQKASGALEHHHHHHHH

SEQ ID NO: 1031 - protein, 58 aa, Artificial Sequence
  Description of Artificial Sequence: Synthetic polypeptide
CAANEFRCSNGRCIPEPWLCDGLNDCGDGSDEPPHCAPPTSLQKASGALEHHHHHHHH

SEQ ID NO: 1032 - protein, 66 aa, Artificial Sequence
  Description of Artificial Sequence: Synthetic polypeptide
CLPNQFRCGNGHCLSRTWVCDGVPDCEDNSDESLAHCSAPASEPPGSLSLQKASGALEHHHHHHHH

SEQ ID NO: 1033 - protein, 66 aa, Artificial Sequence
  Description of Artificial Sequence: Synthetic polypeptide
CPPSQFTCGNGRCVSLGWVCDGLNDCGDGSDESPALCSAPASEPPGSLSLQKASGALEHHHHHHHH

SEQ ID NO: 1034 - protein, 62 aa, Artificial Sequence
  Description of Artificial Sequence: Synthetic polypeptide
CPSNQFPCRSTGICIPLAWVCDGLNDCGDGSDESPATCKAPVPTSLQKASGALEHHHHHHHH

SEQ ID NO: 1035 - protein, 70 aa, Artificial Sequence
  Description of Artificial Sequence: Synthetic polypeptide
CRANEFRCNSGRCLSQTWVCDGVDDCEDGSDESLAICGDSHILPFSTPGPSTSLQKASGALEHHHHHHHH

SEQ ID NO: 1036 - protein, 66 aa, Artificial Sequence
  Description of Artificial Sequence: Synthetic polypeptide
CRPSEFRCRNSNRCIPRAWLCDGLNDCGDGSDEAPHCSAPASEPPGSLSLQKASGALEHHHHHHHH

SEQ ID NO: 1037 - protein, 59 aa, Artificial Sequence
  Description of Artificial Sequence: Synthetic polypeptide
CRSSEFQCGNGHCLSRTWLCDGVNDCGDDSDEKNCAGAAPTSLQKASGALEHHHHHHHH

SEQ ID NO: 1038 - protein, 61 aa, Artificial Sequence
  Description of Artificial Sequence: Synthetic polypeptide
CPSSQFQCKNGHCLSRTWLCDGVDDCQDGSDESPAICTASGHTSLQKASGALEHHHHHHHH

SEQ ID NO: 1039 - protein, 65 aa, Artificial Sequence
  Description of Artificial Sequence: Synthetic polypeptide
CQSNEFRCRSGRCIPQHWLCDGLNDCGDGSDESQQCSAPASEPPGSLSLQKASGALEHHHHHHHH

SEQ ID NO: 1040 - protein, 70 aa, Artificial Sequence
  Description of Artificial Sequence: Synthetic polypeptide
CRANQFTCNNGHCLSRTWLCDGVPDCEDNSDESLAICGDSHILPFSTPGPSTSLQKASGALEHHHHHHHH

SEQ ID NO: 1041 - protein, 57 aa, Artificial Sequence
  Description of Artificial Sequence: Synthetic polypeptide
CRSSQFQCNNGHCLSPTWVCDGYDDCEDGSDEANCPTHTSLQKASGALEHHHHHHHH

SEQ ID NO: 1042 - protein, 69 aa, Artificial Sequence
  Description of Artificial Sequence: Synthetic polypeptide
CASSEFQCRSTRTCVPLGWVCDGDNDCPDNSDETDCGDSHILPFSTPGPSTSLQKASGALEHHHHHHHH

SEQ ID NO: 1043 - protein, 59 aa, Artificial Sequence
  Description of Artificial Sequence: Synthetic polypeptide
CPANQFRCNNGHCLSGTWLCDGVDDCGDNSDESSATCEPHTSLQKASGALEHHHHHHHH

SEQ ID NO: 1044 - protein, 69 aa, Artificial Sequence
  Description of Artificial Sequence: Synthetic polypeptide
CQATAQFQCDNGHCLSANWRCDGVDDCGDNSDEEDCGDSHILPFSTPGPSTSLQKASGALEHHHHHHHH

SEQ ID NO: 1045 - protein, 70 aa, Artificial Sequence
  Description of Artificial Sequence: Synthetic polypeptide
CRPSEFQCGNGSCLSATWLCDGVPDCGDGSDESPETCGDSHILPFSTPGPSTSLQKASGALEHHHHHHHH

SEQ ID NO: 1046 - protein, 57 aa, Artificial Sequence
  Description of Artificial Sequence: Synthetic polypeptide
CRSSEFQCNNGHCLSATWVCDGYDDCEDGSDEANCPTHTSLQKASGALEHHHHHHHH

SEQ ID NO: 1047 - protein, 57 aa, Artificial Sequence
  Description of Artificial Sequence: Synthetic polypeptide
CSAFEFHCLSGECIHSSWRCDMDWDCKDQPDQLWCALETSLQKASGALEHHHHHHHH

SEQ ID NO: 1048 - protein, 57 aa, Artificial Sequence
  Description of Artificial Sequence: Synthetic polypeptide
CSAFEFHCLSGECIHSSWRCDWDDDCKDWQDYVMCALEASLQKASGALEHHHHHHHH

SEQ ID NO: 1049 - protein, 57 aa, Artificial Sequence
  Description of Artificial Sequence: Synthetic polypeptide
CSAFEFHCLSGECIHSSWRCDWDLDCKDHPDEVMCALEASLQKASGALEHHHHHHHH

SEQ ID NO: 1050 - protein, 57 aa, Artificial Sequence
  Description of Artificial Sequence: Synthetic polypeptide
CSAFEFHCLSGECIHSSWRCDWYWDCKDYWDPLVCELEASLQKASGALEHHHHHHHH

SEQ ID NO: 1051 - protein, 66 aa, Artificial Sequence
  Description of Artificial Sequence: Synthetic polypeptide
CQPDEFTCSSGRCIPQPWLCDGLNDCGDGSDEPPAHCSAPASEPPGSLSLQKASGALEHHHHHHHH

SEQ ID NO: 1052 - protein, 71 aa, Artificial Sequence
  Description of Artificial Sequence: Synthetic polypeptide
CKSIAQFECSNGHCLSRTWLCDGVDDCGDNSDEALATCGDSHILPFSTPGPSTSLQKASGALEHHHHHHHH

SEQ ID NO: 1053 - protein, 68 aa, Artificial Sequence
  Description of Artificial Sequence: Synthetic polypeptide
CRPNEFQCGNGHCLSANWLCDGVDDCGDDSDETSCGDSHILPFSTPGPSTSLQKASGALEHHHHHHHH

SEQ ID NO: 1054 - protein, 66 aa, Artificial Sequence
  Description of Artificial Sequence: Synthetic polypeptide
CRPNEFPCNNGRCLSQTWVCDGLNDCGDGSDESPELCSAPASEPPGSLSLQKASGALEHHHHHHHH

SEQ ID NO: 1055 - protein, 70 aa, Artificial Sequence
  Description of Artificial Sequence: Synthetic polypeptide
CAPSQFQCHDNNICLLEGLLCDGEDDCADGSDEAPVCGDSHILPFSTPGPSTSLQKASGALEHHHHHHHH

SEQ ID NO: 1056 - protein, 57 aa, Artificial Sequence
  Description of Artificial Sequence: Synthetic polypeptide
CPANQFRCNNGHCLSRTWVCDGYDDCEDGSDEANCPTHTSLQKASGALEHHHHHHHH

SEQ ID NO: 1057 - protein, 66 aa, Artificial Sequence
  Description of Artificial Sequence: Synthetic polypeptide
CQPDEFTCRSGRCIPQPWLCDGLNDCGDGSDEPPGHCTAPASEPPGSLTLQKASGALEHHHHHHHH

SEQ ID NO: 1058 - protein, 70 aa, Artificial Sequence
  Description of Artificial Sequence: Synthetic polypeptide
CRSNEFKCGNGHCLSRTWLCDGVDDCGDDSDESPATCGDSHFVPFSSLGLNKALGNVYDHLHHHHHYHHH

SEQ ID NO: 1059 - protein, 69 aa, Artificial Sequence
  Description of Artificial Sequence: Synthetic polypeptide
CHSFNQFECRNGQCIPLHLVCDGVPDCGDNSDETDCGDSHILPFSTPGPSTSLQKASGALEHHHHHHHH

SEQ ID NO: 1060 - protein, 70 aa, Artificial Sequence; identical to SEQ ID NO: 1040
  Description of Artificial Sequence: Synthetic polypeptide

SEQ ID NO: 1061 - protein, 59 aa, Artificial Sequence
  Description of Artificial Sequence: Synthetic polypeptide
CLSNQFQCDNGHCLSLTWRCDGYNDCGDSSDEENCAASEHTSLQKASGALEHHHHHHHH

SEQ ID NO: 1062 - protein, 70 aa, Artificial Sequence
  Description of Artificial Sequence: Synthetic polypeptide
CLPGQFRCNSGHCLSQTWVCDGYNDCGDGSDEPLATCGDSHILPFSTPGPSTSLQKASGALEHHHHHHHH

SEQ ID NO: 1063 - protein, 69 aa, Artificial Sequence; identical to SEQ ID NO: 1044
  Description of Artificial Sequence: Synthetic polypeptide

SEQ ID NO: 1064 - protein, 70 aa, Artificial Sequence
  Description of Artificial Sequence: Synthetic polypeptide
CPSSQFQCKNGHCLSRTWLCDGVDDCQDGSDESPATCGDSHILPFSTPGPSTSLQKASGALEHHHHHHHH

SEQ ID NO: 1065 - protein, 59 aa, Artificial Sequence
  Description of Artificial Sequence: Synthetic polypeptide
CRSSEFKCKNGHCLSATWVCDGYVDCGDDSDEEDCATSGHTSLQKASGALEHHHHHHHH

SEQ ID NO: 1066 - protein, 69 aa, Artificial Sequence
  Description of Artificial Sequence: Synthetic polypeptide
CRSSQFPCQDSNICVLETLLCDGVDDCVDDSDEEDCGDSHILPFSTPGPSTSLQKASGALEHHHHHHHH

SEQ ID NO: 1067 - protein, 64 aa, Artificial Sequence; identical to SEQ ID NO: 1030
  Description of Artificial Sequence: Synthetic polypeptide

SEQ ID NO: 1068 - protein, 64 aa, Artificial Sequence
  Description of Artificial Sequence: Synthetic polypeptide
CLPDEFQCGSGRCIPLTWVCDGLNDCGDGSDESPAHCSQDPEFHKVSLQKASGALEHHHHHHHH

SEQ ID NO: 1069 - protein, 64 aa, Artificial Sequence
  Description of Artificial Sequence: Synthetic polypeptide
CLPDEFQCRSGRCIPQTWVCDGLNDCGDGSDESPAQCSQDPEFHKVSLQKASGALEHHHHHHHH

SEQ ID NO: 1070 - protein, 64 aa, Artificial Sequence
  Description of Artificial Sequence: Synthetic polypeptide
CLPHEFQCGSGRCIPQTWVCDGLNDCGDGSDEWPAQCSQDPEFHKVSLQKASGALEHHHHHHHH

SEQ ID NO: 1071 - protein, 64 aa, Artificial Sequence
  Description of Artificial Sequence: Synthetic polypeptide
CLPHEFQCRSGRCIPQAWGCDGLNDCGDGSDESPAQCSQDPEFHKVSLQKASGALEHHHHHHHH

SEQ ID NO: 1072 - protein, 64 aa, Artificial Sequence
  Description of Artificial Sequence: Synthetic polypeptide
CLSDEFQCRSGRCIPQRWVCDGLNDCGDGSDEWPAQCSQDPEFHKVSLQKASGALEHHHHHHHH

SEQ ID NO: 1073 - protein, 64 aa, Artificial Sequence
  Description of Artificial Sequence: Synthetic polypeptide
CMPDEFQCRSGRCIPRSWVCDGLNDCGDGSDESPSHCSQDPEFHKVSLQKASGALEHHHHHHHH

SEQ ID NO: 1074 - protein, 64 aa, Artificial Sequence
  Description of Artificial Sequence: Synthetic polypeptide
CMTDEFRCRSGRCIPQTWVCDGLNDCGDGSDEWPAQCSQDPEFHKVSLQKASGALEHHHHHHHH

SEQ ID NO: 1075 - protein, 64 aa, Artificial Sequence
  Description of Artificial Sequence: Synthetic polypeptide
CPPDEFQCRSGWCIPQKWVCDGLNDCGDGSDESPALCSQDPEFHKVSLQKASGALEHHHHHHHH

SEQ ID NO: 1076 - protein, 57 aa, Artificial Sequence; identical to SEQ ID NO: 1041
  Description of Artificial Sequence: Synthetic polypeptide

SEQ ID NO: 1077 - protein, 57 aa, Artificial Sequence
  Description of Artificial Sequence: Synthetic polypeptide
CLPSQFQCNNGHCLSRTWVCDGYDDCGDWSDESNCPTHTSLQKASGALEHHHHHHHH

SEQ ID NO: 1078 - protein, 57 aa, Artificial Sequence
  Description of Artificial Sequence: Synthetic polypeptide
CLSGQFQCSNGHCLSRTWVCDGYVDCEDGSDEAKCPTHTSLQKASGALEHHHHHHHH

SEQ ID NO: 1079 - protein, 57 aa, Artificial Sequence
  Description of Artificial Sequence: Synthetic polypeptide
CLSSSFQCNNGHCLSRTWVCDGYYDCEDGSDEVNCPTHTSLQKASGALEHHHHHHHH

SEQ ID NO: 1080 - protein, 57 aa, Artificial Sequence
  Description of Artificial Sequence: Synthetic polypeptide
CRSGQFQCNNGHCLSATWVCDGYDDCDDGSDEANCPTHTSLQKASGALEHHHHHHHH

SEQ ID NO: 1081 - protein, 57 aa, Artificial Sequence
  Description of Artificial Sequence: Synthetic polypeptide
CRSGQFQCNNGHCLSQTWVCDGYDDCDDGSDEANCPTHTSLQKASGALEHHHHHHHH

SEQ ID NO: 1082 - protein, 57 aa, Artificial Sequence
  Description of Artificial Sequence: Synthetic polypeptide
CRSGQFQCNNGHCLSRTWVCDGYDDCDDGSDEANCPTHTSLQKASGALEHHHHHHHH

SEQ ID NO: 1083 - protein, 57 aa, Artificial Sequence
  Description of Artificial Sequence: Synthetic polypeptide
CRSGQFQCNNGHCLSSTWVCDGFDDCEDGSDEANCPTHTSLQKASGALEHHHHHHHH

SEQ ID NO: 1084 - protein, 57 aa, Artificial Sequence
  Description of Artificial Sequence: Synthetic polypeptide
CRSSEFQCNNGHCLSATWVCDGYDDCEDGSDESNCPTHTSLQKASGALEHHHHHHHH

SEQ ID NO: 1085 - protein, 57 aa, Artificial Sequence
  Description of Artificial Sequence: Synthetic polypeptide
CRSSEFQCNTGHCLSRTWVCDGYDDCGDGSDEANCPTHTSLQKASGALEHHHHHHHH

SEQ ID NO: 1086 - protein, 57 aa, Artificial Sequence
  Description of Artificial Sequence: Synthetic polypeptide
CRTSHFHCNNGHRLSRTWVCDGYEDCEDGSDEANCPTHTSLQKASGALEHHHHHHHH

SEQ ID NO: 1087 - protein, 57 aa, Artificial Sequence
  Description of Artificial Sequence: Synthetic polypeptide
CWSSAFQCNNGHCLSPSWVCDGYDDCGDGSDEANCPTHTSLQKASGALEHHHHHHHH

SEQ ID NO: 1088 - protein, 57 aa, Artificial Sequence; identical to SEQ ID NO: 1080
  Description of Artificial Sequence: Synthetic polypeptide

SEQ ID NO: 1089 - protein, 66 aa, Artificial Sequence; identical to SEQ ID NO: 1051
  Description of Artificial Sequence: Synthetic polypeptide

SEQ ID NO: 1090 - protein, 66 aa, Artificial Sequence
  Description of Artificial Sequence: Synthetic polypeptide
CEPEEFRCRSGRCIPQTWLCDGLNDCGDGSDEPPAHCSAPASEPPGSLSLQKASGALEHHHHHHHH

SEQ ID NO: 1091 - protein, 66 aa, Artificial Sequence
  Description of Artificial Sequence: Synthetic polypeptide
CQPDEFTCRSGRCIPQSWLCDGLNDCGDGSDEPPAHCSAPASEPPGSLSLQKASGALEHHHHHHHH

SEQ ID NO: 1092 - protein, 66 aa, Artificial Sequence
  Description of Artificial Sequence: Synthetic polypeptide
CQPDEFTCSSGRCIPQIWLCDGLNDCGDGSDERPEHCSAPASEPPGSLSLQKASGALEHHHHHHHH

SEQ ID NO: 1093 - protein, 66 aa, Artificial Sequence
  Description of Artificial Sequence: Synthetic polypeptide
CQSDEFMCSSGRCIPVHWLCDGLNDCGDGSDERPAQCSAPASEPPGSLSLQKASGALEHHHHHHHH

SEQ ID NO: 1094 - protein, 69 aa, Artificial Sequence; identical to SEQ ID NO: 1059
  Description of Artificial Sequence: Synthetic polypeptide

SEQ ID NO: 1095 - protein, 68 aa, Artificial Sequence
  Description of Artificial Sequence: Synthetic polypeptide
CHSFNQFECRNRQCIPLYLVCDGVPDCADNSDETDCGDSYLPFSTPGPSTSLQKASGALEHHHHHHHH

SEQ ID NO: 1096 - protein, 69 aa, Artificial Sequence
  Description of Artificial Sequence: Synthetic polypeptide
CHTFNKFECRNGQCIPLYLVCDGVPDCGDNSDETACGDSHILPFSTPGPSTSLQKASGALEHHHHHHHH

SEQ ID NO: 1097 - protein, 69 aa, Artificial Sequence
  Description of Artificial Sequence: Synthetic polypeptide
CNSFNQFECRNRQCIPLYLVCDGVPDCGDNSDETYCGDSHILPFSTPGPSTSLQKASGALEHHHHHHHH

SEQ ID NO: 1098 - protein, 69 aa, Artificial Sequence
  Description of Artificial Sequence: Synthetic polypeptide
CPWFHHFKCRNGQRIPLHLVCDGVPDCGDDSDETDCGDSHILPFSTPGPSTSLQKASGALEHHHHHHHH

SEQ ID NO: 1099 - protein, 100 aa, Artificial Sequence
  Description of Artificial Sequence: Synthetic polypeptide
CPPDQFRCRSGRCIPQHWLCDGLNDCGDGSDEANCEKRTCLPDEFQCGSGRCIPQTWVCDGLNDCGDGSDESPATCKAPVPTSLQKASGALEHHHHHHHH

SEQ ID NO: 1100 - protein, 105 aa, Artificial Sequence
  Description of Artificial Sequence: Synthetic polypeptide
CAPDQFRCSSGQCIPETWLCDGDDDCVDSSDEAGCASTVPTCLPDEFQCGSGRCIPQTWVCDGLNDCGDGSDESPAHCSQDPEFHKVSLQKASGALEHHHHHHHH

SEQ ID NO: 1101 - protein, 107 aa, Artificial Sequence
  Description of Artificial Sequence: Synthetic polypeptide
CGPDEFRCNSGRCLPLDWRCDGVDDCEDGSDEAPDLCKTPARTCLPDEFQCGSGRCIPQTWVCDGLNDCGDGSDESPAHCSQDPEFHKVSLQKASGALEHHHHHHHH

SEQ ID NO: 1102 - protein, 103 aa, Artificial Sequence
  Description of Artificial Sequence: Synthetic polypeptide
CGPDQFRCKSGNCLPLNWVCDGVDDCGDSSDEEGCATPTCLPDEFQCGSGRCIPQTWVCDGLNDCGDGSDESPAHCSQDPEFHKVSLQKASGALEHHHHHHHH

SEQ ID NO: 1103 - protein, 108 aa, Artificial Sequence
  Description of Artificial Sequence: Synthetic polypeptide
CLPDEFQCGSGRCIPQTWVCDGLNDCGDGSDESPAHCSQDPEFHKVCPSNQFPCRSTGICIPLAWVCDGLNDCGDGSDESPATCKAPVPTSLQKASGALEHHHHHHHH

SEQ ID NO: 1104 - protein, 106 aa, Artificial Sequence
  Description of Artificial Sequence: Synthetic polypeptide
CLPDEFRCGSGRCIPQTWVCDGLNDCGDGSDETGCRRPGPTCLPDEFQCGSGRCIPQTWVCDGLNDCGDGSDESQQCSAPASEPPGSLSLQKASGALEHHHHHHHH

SEQ ID NO: 1105 - protein, 105 aa, Artificial Sequence; identical to SEQ ID NO: 1100
  Description of Artificial Sequence: Synthetic polypeptide

SEQ ID NO: 1106 - protein, 103 aa, Artificial Sequence
  Description of Artificial Sequence: Synthetic polypeptide
CGPDQFKCNSGSCIPLTWVCDGDNDCGDDSDETDCTKRTCLPDEFQCGSGRCIPQTWVCDGLNDCGDGSDESPAHCSQDPEFHKVSLQKASGALEHHHHHHHH

SEQ ID NO: 1107 - protein, 105 aa, Artificial Sequence
  Description of Artificial Sequence: Synthetic polypeptide
CLPDEFQCGSGRCIPQHWLCDGLNDCGDGSDEPPAHCSAPASEPPGSLCRAGEFRCSNGRCVPLTWLCDGEDDCQDNSDEKNCAQPTSLQKASGALEHHHHHHHH

SEQ ID NO: 1108 - protein, 105 aa, Artificial Sequence
  Description of Artificial Sequence: Synthetic polypeptide
CLPDEFQCSSGRCIPQTWVCDGLNDCGDGSDESPAHCSQDPEFHKVCPSSEFRCNNGRCIPLHWVCDGDDDCQDNSDETDCERSGRTSLQKASGALEHHHHHHHH

SEQ ID NO: 1109 - protein, 110 aa, Artificial Sequence
  Description of Artificial Sequence: Synthetic polypeptide
CLPDEFQCGSGRCIPQTWVCDGLNDCGDGSDESPAHCSQDPEFHKVCRPGEFRCNNGRCVPQTWVCDGEDDCGDNSDETDCSAPASEPPGSLSLQKASGALEHHHHHHHH

SEQ ID NO: 1110 - protein, 103 aa, Artificial Sequence
  Description of Artificial Sequence: Synthetic polypeptide
CLPDEFQCGSGRCIPQTWVCDGLNDCGDGSDESPAHCSQDPEFHKVCLSDQFRCGNGRCVPRAWLCDGDNDCQDGSDETNCEQPTSLQKASGALEHHHHHHHH

SEQ ID NO: 1111 - protein, 105 aa, Artificial Sequence
  Description of Artificial Sequence: Synthetic polypeptide
CLPDEFQCGSGRCIPQTWVCDGLNDCGDGSDESPAHCSQDPEFHKVCLPGQFPCGNGRCIPETWLCDGDDDCQDGSDEKGCTASGRTSLQKASGALEHHHHHHHH

SEQ ID NO: 1112 - protein, 103 aa, Artificial Sequence
  Description of Artificial Sequence: Synthetic polypeptide
CLPDEFQCGSGRCIPQTWVCDGLNDCGDGSDESPAHCSQDPEFHKVCQPNEFQCGNGRCIPAQWLCDGEDDCQDNSDEEDCTEHTSLQKASGALEHHHHHHHH

SEQ ID NO: 1113 - protein, 106 aa, Artificial Sequence
  Description of Artificial Sequence: Synthetic polypeptide
CLPDEFQCGSGRCIPQTWVCDGLNDCGDGSDESPAHCSQDPEFHKVCESIGQFECGNGHCIPPTWLCDGVNDCQDSSDEALAHCEPPTSLQKASGALEHHHHHHHH

SEQ ID NO: 1114 - protein, 103 aa, Artificial Sequence
  Description of Artificial Sequence: Synthetic polypeptide
CLPDEFQCGSGRCIPQTWVCDGLNDCGDGSDESPAHCSQDPEFHKVCQSNEFRCRNGQCIPLTWLCDGDNDCLDSSDEESCPAHTSLQKASGALEHHHHHHHH

SEQ ID NO: 1115 - protein, 105 aa, Artificial Sequence
  Description of Artificial Sequence: Synthetic polypeptide
CLPDEFQCGSGRCIPQTWVCDGLNDCGDGSDESPAHCSQDPEFHKVCPSGEFTCGSGRCIPPTWVCDGEPDCLDGSDEKSCTATVRTSLQKASGALEHHHHHHHH

SEQ ID NO: 1116 - protein, 102 aa, Artificial Sequence
  Description of Artificial Sequence: Synthetic polypeptide
CLPDEFQCGSGRCIPQTWVCDGLNDCGDGSDESPATCKAPVPTCLPDEFKCGSGRCIPLRWVCDGDDDCQDGSDETDCGGAEPTSLQKASGALEHHHHHHHH

SEQ ID NO: 1117 - protein, 107 aa, Artificial Sequence
  Description of Artificial Sequence: Synthetic polypeptide
CLPDEFQCGSGRCIPQTWVCDGLNDCGDGSDEPPAHCSAPASEPPGSLCRSDEFRCGNGRCIPLTWVCDGEDDCQDSSDETGCTTPGHTSLQKASGALEHHHHHHHH

SEQ ID NO: 1118 - protein, 105 aa, Artificial Sequence
  Description of Artificial Sequence: Synthetic polypeptide
CLPDEFQCGSGRCIPQTWVCDGLNDCGDGSDEPPAHCSAPASEPPGSLCRSNQFTCGNGNCIPQPWVCDGEDDCGDDSDEESCKEHTSLQKASGALEHHHHHHHH

SEQ ID NO: 1119 - protein, 105 aa, Artificial Sequence
  Description of Artificial Sequence: Synthetic polypeptide
CLPDEFQCGSGRCIPQTWVCDGLNDCGDGSDESPAHCSQDPEFHKVCPPGQFRCNNGRCIPVHWRCDGENDCQDDSDEKSCKGPEHTSLQKASGALEHHHHHHHH

SEQ ID NO: 1120 - protein, 112 aa, Artificial Sequence
  Description of Artificial Sequence: Synthetic polypeptide
CASNQFRCGNGHCLSRTWLCDGVNDCEDGSDEADCSAPASEPPGSLCPPSQFTCGNGRCVSLGWVCDGLNDCGDGSDESPALCSAPASEPPGSLSLQKASGALEHHHHHHHH

SEQ ID NO: 1121 - protein, 108 aa, Artificial Sequence
  Description of Artificial Sequence: Synthetic polypeptide
CAPDEFRCHNTGTCIPRAWLCDGDNDCGDGSDEEGCKGSGPTCPPSQFTCGNGRCVSLGWVCDGLNDCGDGSDESPALCSAPASEPPGSLSLQKASGALEHHHHHHHH

SEQ ID NO: 1122 - protein, 108 aa, Artificial Sequence
  Description of Artificial Sequence: Synthetic polypeptide
CAPSQFQCHDNNICLLEGLLCDGEDDCADGSDEADCAAPEHTCPPSQFTCGNGRCVSLGWVCDGLNDCGDGSDESPALCSAPASEPPGSLSLQKASGALEHHHHHHHH

SEQ ID NO: 1123 - protein, 112 aa, Artificial Sequence; identical to SEQ ID NO: 1120
  Description of Artificial Sequence: Synthetic polypeptide

SEQ ID NO: 1124 - protein, 107 aa, Artificial Sequence
  Description of Artificial Sequence: Synthetic polypeptide
CPPSQFTCGNGRCVSLGWVCDGLNDCGDGSDESPALCSAPASEPPGSLCPPDQFRCRNGRCVPLAWVCDGEDDCQDNSDETDCKRSVRTSLQKASGALEHHHHHHHH

SEQ ID NO: 1125 - protein, 109 aa, Artificial Sequence
  Description of Artificial Sequence: Synthetic polypeptide
CPPSQFTCGNGRCVSLGWVCDGLNDCGDGSDESPALCSAPASEPPGSLCAPGEFTCKSGQCIPLHWLCDGDNDCGDNSDESPATCKATVPTSLQKASGALEHHHHHHHH

SEQ ID NO: 1126 - protein, 107 aa, Artificial Sequence
  Description of Artificial Sequence: Synthetic polypeptide
CPPSQFTCGNGRCVSLGWVCDGLNDCGDGSDESPALCSAPASEPPGSLCPPGQFRCNNGRCIPQPWLCDGDDDCQDNSDEENCESPGPTSLQKASGALEHHHHHHHH

SEQ ID NO: 1127 - protein, 107 aa, Artificial Sequence
  Description of Artificial Sequence: Synthetic polypeptide
CAPGEFTCKNTGRCIPLNWRCDGDDDCGDGSDETDCPAPTCPSNQFPCRSTGICIPLAWVCDGLNDCGDGSDESPAHCSAPASEPPGSLSLQKASGALEHHHHHHHH

SEQ ID NO: 1128 - protein, 102 aa, Artificial Sequence
  Description of Artificial Sequence: Synthetic polypeptide
CPADEFRCSNTGRCVPLSWLCDGEDDCGDGSDETNCKAHTCPSNQFPCRSTGICIPLAWVCDGLNDCGDGSDESPATCKAPVPTSLQKASGALEHHHHHHHH

SEQ ID NO: 1129 - protein, 110 aa, Artificial Sequence
  Description of Artificial Sequence: Synthetic polypeptide
CRPNEFRCGNGHCLSQTWVCDGVDDCLDGSDEESCGRPGPGATSAPAACPSNQFPCRGTGICIPLAWVCDGLNDCGDGSDESPATCKAPVPTSLQKASGALEHHHHHHHH

SEQ ID NO: 1130 - protein, 106 aa, Artificial Sequence
  Description of Artificial Sequence: Synthetic polypeptide
CGPDQFRCSSGKCIPQHWLCDGLNDCGDGSDESPATCQRHTCQSNEFRCRSGRCIPQHWLCDGLNDCGDGSDESQQCSAPASEPPGSLSLQKASGALEHHHHHHHH

SEQ ID NO: 1131 - protein, 118 aa, Artificial Sequence
  Description of Artificial Sequence: Synthetic polypeptide
CGANEFQCRSTGICVPVEWVCDGDNDCGDGSDEPPVCGDSHILPFSTPGPSTCQPDEFTCSSGRCIPQPWLCDGLNDCGDGSDEPPAHCSAPASEPPGSLSLQKASGALEHHHHHHHH

SEQ ID NO: 1132 - protein, 106 aa, Artificial Sequence
  Description of Artificial Sequence: Synthetic polypeptide
CGADQFRCGNGSCVPRAWRCDGVDDCGDGSDEAPEICETPTCQSNEFRCRSGRCIPQHWLCDGLNDCGDGSDESQQCSAPASEPPGSLSLQKASGALEHHHHHHHH

SEQ ID NO: 1133 - protein, 107 aa, Artificial Sequence
  Description of Artificial Sequence: Synthetic polypeptide
CGPDEFRCNNGQCIPLPWRCDGVDDCGDNSDEPLEICQAPTCQSNEFRCRSGRCIPQHWLCDGLNDCGDGSDEPPAHCSAPASEPPGSLSLQKASGALEHHHHHHHH

SEQ ID NO: 1134 - protein, 103 aa, Artificial Sequence
  Description of Artificial Sequence: Synthetic polypeptide
CASGEFTCNNGQCVPLAWRCDGVNDCQDGSDEKGCTPHTCQSNEFRCRSGRCIPQHWLCDGLNDCGDGSDESPAHCSQDPEFHKVSLQKASGALEHHHHHHHH

SEQ ID NO: 1135 - protein, 107 aa, Artificial Sequence; identical to SEQ ID NO: 1133
  Description of Artificial Sequence: Synthetic polypeptide

SEQ ID NO: 1136 - protein, 107 aa, Artificial Sequence
  Description of Artificial Sequence: Synthetic polypeptide
CPPDEFQCRGTKKCLPLAWVCDGDNDCEDDSDEESCASAVHTCQSNEFRCRSGRCIPQHWLCDGLNDCGDGSDESQQCSAPASEPPGSLSLQKASGALEHHHHHHHH

SEQ ID NO: 1137 - protein, 104 aa, Artificial Sequence
  Description of Artificial Sequence: Synthetic polypeptide
CQSNEFRCRSGRCIPQHWLCDGLNDCGDGSDESQQCSAPASEPPGSLCPPGQFRCRNGSCIPATWLCDGDNDCGDNSDEEDCTPPTSLQKASGALEHHHHHHHH

SEQ ID NO: 1138 - protein, 105 aa, Artificial Sequence
  Description of Artificial Sequence: Synthetic polypeptide
CQSNEFRCRSGRCIPQHWLCDGLNDCGDGSDEPPAHCSAPASEPPGSLCAANQFTCGNGNCIPLHWVCDGDNDCQDGSDETNCEEHTSLQKASGALEHHHHHHHH

SEQ ID NO: 1139 - protein, 110 aa, Artificial Sequence
  Description of Artificial Sequence: Synthetic polypeptide
CRASQFQCNNGHCLSPTWVCDGYDDCDDGSDEAICPTHTSLDYAPGLEASGGSCRSSQFQCNSGHCLSQTWVCDGYDDCEDGSDEAYCPTHTSLQKASGALEHHHHHHHH

SEQ ID NO: 1140 - protein, 110 aa, Artificial Sequence
  Description of Artificial Sequence: Synthetic polypeptide
CRASQFQCNNGHCLSPTWVCDGYDDCDDGSDEAICPTHTSLDYAPGLEASGGSCRSSQFQCNSGHCLSQTWVCDGYDDCQDASDESNCPTHTSLQKASGALEHHHHHHHH

SEQ ID NO: 1141 - protein, 110 aa, Artificial Sequence
  Description of Artificial Sequence: Synthetic polypeptide
CRSSQFQCNNGHCLSPTWVCDGYDDCGDGSDEANCPTHTSLDYAPGLEASGGSCRSSQFQCSNGHCLWPTWVCDGYDDCEDGSDEANCPTHTSLQKASGALEHHHHHHHH

SEQ ID NO: 1142 - protein, 110 aa, Artificial Sequence
  Description of Artificial Sequence: Synthetic polypeptide
CWSRAFQCNNGHCLSQTWVCDGYDDCEDGSDEANCPTHTSLDYAPGLEASGGSCRSRHFHCHKGHCHLPTGVCDGYDDCEDGSDEANCPTHTSLQKASGALEHHHHHHHH

SEQ ID NO: 1143 - protein, 112 aa, Artificial Sequence
  Description of Artificial Sequence: Synthetic polypeptide
CAPDQFRCKSGNCIPLAWRCDGEDDCRDGSDEESCSAPASEPPGSLCQPDEFTCSSGRCIPQPWLCDGLNDCGDGSDEPPAHCSAPASEPPGSLSLQKASGALEHHHHHHHH

SEQ ID NO: 1144 - protein, 102 aa, Artificial Sequence
  Description of Artificial Sequence: Synthetic polypeptide
CQAGQFQCESGNCVPPNWLCDGENDCADSSDEANCRRAAHTCQPDEFTCSSGRCIPLAWVCDGLNDCGDGSDESPATCKAPVPTSLQRASGALEHHHHHHHH

SEQ ID NO: 1145 - protein, 116 aa, Artificial Sequence
  Description of Artificial Sequence: Synthetic polypeptide
CPSGQFQCNNGHCLSATWLCDGVDDCGDGSDEKGCGDSHILPFSTPGPSTCQPDEFTCSSGRCIPQPWLCDGLNDCGDGSDEPPAHCSAPASEPPGSLSLQKASGALEHHHHHHHH

SEQ ID NO: 1146 - protein, 108 aa, Artificial Sequence
  Description of Artificial Sequence: Synthetic polypeptide
CRPDEFPCRSTGRCVPRRWVCDGVDDCGDNSDESLAHCQTPTCQPDEFTCSSGRCIPQPWLCDGLNDCGDGSDEPPAHCSAPASEPPGSLSLQKASGALEHHHHHHHH

SEQ ID NO: 1147 - protein, 103 aa, Artificial Sequence
  Description of Artificial Sequence: Synthetic polypeptide
CQPDEFQCGSGRCIPQTWVCDGLNDCGDGSDESPAHCSQDPEFHKVCRPGEFQCGSGHCIPGPWVCDGDPDCQDGSDEANCEQRTSLQKASGALEHHHHHHHH

SEQ ID NO: 1148 - protein, 107 aa, Artificial Sequence
  Description of Artificial Sequence: Synthetic polypeptide
CQPDEFTCSSGRCIPQPWLCDGLNDCGDGSDEPPAHCSAPASEPPGSLCRPDEFRCKNGRCIPQTWVCDGEDDCQDSSDETDCESTVRTSLQKASGALEHHHHHHHH

SEQ ID NO: 1149 - protein, 105 aa, Artificial Sequence
  Description of Artificial Sequence: Synthetic polypeptide
CQPDEFTCSSGRCIPQPWLCDGLNDCGDGSDEPPAHCSAPASEPPGSLCRPDEFRCRNGRCVPLTWRCDGEDDCQDGSDEEGCAPPTSLQKASGALEHHHHHHHH

SEQ ID NO: 1150 - protein, 109 aa, Artificial Sequence
  Description of Artificial Sequence: Synthetic polypeptide
CAPGEFQCSNGNCLPPNWLCDGVDDCGDGSDESADCTEPTCHSFNQFECRNGQCIPLHLVCDGVPDCGDNSDETDCGDPHILPFSTPGPSTSLQKASGALEHHHHHHHH

SEQ ID NO: 1151 - protein, 110 aa, Artificial Sequence
  Description of Artificial Sequence: Synthetic polypeptide
CAPDEFRCRNGNCIPLPWVCDGENDCRDDSDEEDCEAPGRTCHSFNQFECRNGQCIPLHLVCDGVPDCGDNSDETDCGDSHILPFSTPGPSTSLQKASGALEHHHHHHHH

SEQ ID NO: 1152 - protein, 109 aa, Artificial Sequence
  Description of Artificial Sequence: Synthetic polypeptide
CLSDQFQCNNYETCIPRPWLCDGDDDCVDGSDEEDCETRTCHSFNQFECRNGQCIPLHLVCDGVPDCGDNSDETDCGDSHILPFSTPGPSTSLQKASGALEHHHHHHHH

SEQ ID NO: 1153 - protein, 110 aa, Artificial Sequence
  Description of Artificial Sequence: Synthetic polypeptide
CAAGEFQCSSGRCLPRPWVCDGDNDCGDDSDETNCRASAHTCHSFNQFECRNGQCIPLHLVCDGVPDCGDNSDETDCGDSHILPFSTPGPSTSLQKASGALEHHHHHHHH

SEQ ID NO: 1154 - protein, 117 aa, Artificial Sequence
  Description of Artificial Sequence: Synthetic polypeptide
CRSGEFRCKNGRCIPQHWVCDGENDCGDDSDETNCGRQGPGATSAPAACHSFNQFECRNGQCIPLHLVCDGVPDCGDNSDETDCGDSHILPFSTPGPSTSLQKASGALEHHHHHHHH

SEQ ID NO: 1155 - protein, 109 aa, Artificial Sequence
  Description of Artificial Sequence: Synthetic polypeptide
CAAGQFRCHNSDTCLPGAWVCDGDNDCGDNSDEASCQKRTCHSFNQFECRNGQCIPLHLVCDGVPDCGDNSDETDCGDSHILPFSTPGPSTSLQKASGALEHHHHHHHH

SEQ ID NO: 1156 - protein, 109 aa, Artificial Sequence
  Description of Artificial Sequence: Synthetic polypeptide
CAPNEFRCRSTGRCIPVNWVCDGDDDCADNSDEAGCPEPTCHSFNRFECRNGQCIPLHLVCDGVPDCGDNSDETDCGDSHILPFSTPGPSTSLQKASGALEHHHHHHHH

SEQ ID NO: 1157 - protein, 113 aa, Artificial Sequence
  Description of Artificial Sequence: Synthetic polypeptide
CGADQFQCGSGRCVPATWRCDGEDDCGDGSDEENCSQDPEFHKVCHSFNQFECRNGQCIPLHLVCDGVPDCGDNSDETDCGDSHILPFSTPGPSTSLQKASGALEHHHHHHHH

SEQ ID NO: 1158 - protein, 108 aa, Artificial Sequence
  Description of Artificial Sequence: Synthetic polypeptide
CLPGQFTCGNGRCIPLPWVCDGVNDCEDNSDEESCEQHTCHSFNQFECRNGQCIPLHLVCDGVPDCGDNSDETDCGDSHILPFSTPGPSTSLQKASGALEHHHHHHHH

SEQ ID NO: 1159 - protein, 117 aa, Artificial Sequence
  Description of Artificial Sequence: Synthetic polypeptide
CHSFNQFECRNGQCIPLHLVCDGVPDCGDNSDETDCGDSHILPFSTPGPSTCLPGQFRCKTGRCIPRAWVCDGVDDCEDDSDEADCGRPGPGATSAPAASLQKASGALEHHHHHHHH

SEQ ID NO: 1160 - protein, 65 aa, Artificial Sequence; identical to SEQ ID NO: 999
  Description of Artificial Sequence: Synthetic polypeptide

SEQ ID NO: 1161 - protein, 63 aa, Artificial Sequence; identical to SEQ ID NO: 1004
  Description of Artificial Sequence: Synthetic polypeptide

SEQ ID NO: 1162 - protein, 65 aa, Artificial Sequence; identical to SEQ ID NO: 1011
  Description of Artificial Sequence: Synthetic polypeptide

SEQ ID NO: 1163 - protein, 63 aa, Artificial Sequence; identical to SEQ ID NO: 1017
  Description of Artificial Sequence: Synthetic polypeptide

SEQ ID NO: 1164 - protein, 65 aa, Artificial Sequence; identical to SEQ ID NO: 1024
  Description of Artificial Sequence: Synthetic polypeptide

SEQ ID NO: 1165 - protein, 57 aa, Artificial Sequence; identical to SEQ ID NO: 1026
  Description of Artificial Sequence: Synthetic polypeptide

SEQ ID NO: 1166 - protein, 59 aa, Artificial Sequence
  Description of Artificial Sequence: Synthetic polypeptide
CIAAKLCEALDGDGVCHKECDLEECDWDGGDCQRIFLTDPTSLQKASGALEHHHHHHHH

SEQ ID NO: 1167 - protein, 64 aa, Artificial Sequence; identical to SEQ ID NO: 1074
  Description of Artificial Sequence: Synthetic polypeptide

SEQ ID NO: 1168 - protein, 57 aa, Artificial Sequence; identical to SEQ ID NO: 1087
  Description of Artificial Sequence: Synthetic polypeptide

SEQ ID NO: 1169 - protein, 64 aa, Artificial Sequence
  Description of Artificial Sequence: Synthetic polypeptide
CWSGAFECKNGHCLSRTWVCDGFDDCGDGSDESAAHCSQDPEFHKVSLQKASGALEHHHHHHHH

SEQ ID NO: 1170 - protein, 105 aa, Artificial Sequence; identical to SEQ ID NO: 1107
  Description of Artificial Sequence: Synthetic polypeptide

SEQ ID NO: 1171 - protein, 105 aa, Artificial Sequence; identical to SEQ ID NO: 1108
  Description of Artificial Sequence: Synthetic polypeptide

SEQ ID NO: 1172 - protein, 105 aa, Artificial Sequence
  Description of Artificial Sequence: Synthetic polypeptide
CLPDEFRCGNGNCISVAWRCDGVDDCEDGSDEEDCESPEHTCQSNEFRCRSGRCIPQHWLCDGLNDCGDGSDESPAHCSQDPEFHKVSLQKASGALEHHHHHHHH

SEQ ID NO: 1173 - protein, 110 aa, Artificial Sequence; identical to SEQ ID NO: 1140
  Description of Artificial Sequence: Synthetic polypeptide

SEQ ID NO: 1174 - protein, 109 aa, Artificial Sequence; identical to SEQ ID NO: 1155
  Description of Artificial Sequence: Synthetic polypeptide

SEQ ID NO: 1175 - protein, 105 aa, Artificial Sequence; identical to SEQ ID NO: 1100
  Description of Artificial Sequence: Synthetic polypeptide

SEQ ID NO: 1176 - protein, 109 aa, Artificial Sequence; identical to SEQ ID NO: 1156
  Description of Artificial Sequence: Synthetic polypeptide

SEQ ID NO: 1177 - protein, 112 aa, Artificial Sequence; identical to SEQ ID NO: 1120
  Description of Artificial Sequence: Synthetic polypeptide

SEQ ID NO: 1178 - protein, 107 aa, Artificial Sequence; identical to SEQ ID NO: 1133
  Description of Artificial Sequence: Synthetic polypeptide

SEQ ID NO: 1179 - protein, 110 aa, Artificial Sequence; identical to SEQ ID NO: 1129
  Description of Artificial Sequence: Synthetic polypeptide

SEQ ID NO: 1180 - protein, 111 aa, Artificial Sequence
  Description of Artificial Sequence: Synthetic polypeptide
CGANQFTCHNTNICISQAWVCDGVDDCEDNSDEKNCSAPASEPPGSLCLPDEFQCGSGRCIPQTWVCDGLNDCGDGSDESPAHCSQDPEFHKVSLQKASGALEHHHHHHHH

SEQ ID NO: 1181 - protein, 116 aa, Artificial Sequence
  Description of Artificial Sequence: Synthetic polypeptide
CGANQFTCHNTNICISQAWVCDGVDDCEDNSDEKNCSAPASEPPGSLGGGGSCLPDEFQCGSGRCIPQTWVCDGLNDCGDGSDESPAHCSQDPEFHKVSLQKASGALEHHHHHHHH

SEQ ID NO: 1182 - protein, 121 aa, Artificial Sequence
  Description of Artificial Sequence: Synthetic polypeptide
CGANQFTCHNTNICISQAWVCDGVDDCEDNSDEKNCSAPASEPPGSLGGGGSGGGGSCLPDEFQCGSGRCIPQTWVCDGLNDCGDGSDESPAHCSQDPEFHKVSLQKASGALEHHHHHHHH

SEQ ID NO: 1183 - protein, 126 aa, Artificial Sequence
  Description of Artificial Sequence: Synthetic polypeptide
CGANQFTCHNTNICISQAWVCDGVDDCEDNSDEKNCSAPASEPPGSLGGGGSGGGGSGGGGSCLPDEFQCGSGRCIPQTWVCDGLNDCGDGSDESPAHCSQDPEFHKVSLQKASGALEHHHHHHHH

SEQ ID NO: 1184 - protein, 111 aa, Artificial Sequence
  Description of Artificial Sequence: Synthetic polypeptide
CLPDEFQCGSGRCIPQTWVCDGLNDCGDGSDESPAHCSQDPEFHKVCGANQFTCHNTNICISQAWVCDGVDDCEDNSDEKNCSAPASEPPGSLSLQKASGALEHHHHHHHH

SEQ ID NO: 1185 - protein, 123 aa, Artificial Sequence
  Description of Artificial Sequence: Synthetic polypeptide
CLPDEFQCGSGRCIPQTWVCDGLNDCGDGSDESPAHCSQDPELHKVSLGGGGSGGGGSCGANQFTCHNTNICISQAWVCDGVDDCEDNSDEKNCSAPASEPPGSLSLQKASGALEHHHHHHHH

SEQ ID NO: 1186 - protein, 128 aa, Artificial Sequence
  Description of Artificial Sequence: Synthetic polypeptide
CLPDEFQCGSGRCIPQTWVCDGLNDCGDGSDESPAHCSQDPELHKVSLGGGGSGGGGSGGGGSCGANQFTCHNTNICISQAWVCDGVDDCEDNSDEKNCSAPASEPPGSLSLQKASGALEHHHHHHHH

SEQ ID NO: 1187 - protein, 113 aa, Artificial Sequence
  Description of Artificial Sequence: Synthetic polypeptide
CGANQFTCHNTNICISQAWVCDGVDDCEDNSDEKNCSAPASEPPGSLCQPDEFTCSSGRCIPQPWLCDGLNDCGDGSDEPPAHCSAPASEPPGSLSLQKASGALEHHHHHHHH

SEQ ID NO: 1188 - protein, 118 aa, Artificial Sequence
  Description of Artificial Sequence: Synthetic polypeptide
CGANQFTCHNTNICISQAWVCDGVDDCEDNSDEKNCSAPASEPPGSLGGGGSCQPDEFTCSSGRCIPQPWLCDGLNDCGDGSDEPPAHCSAPASEPPGSLSLQKASGALEHHHHHHHH

SEQ ID NO: 1189 - protein, 123 aa, Artificial Sequence
  Description of Artificial Sequence: Synthetic polypeptide
CGANQFTCHNTNICISQAWVCDGVDDCEDNSDEKNCSAPASEPPGSLGGGGSGGGGSCQPDEFTCSSGRCIPQPWLCDGLNDCGDGSDEPPAHCSAPASEPPGSLSLQKASGALEHHHHHHHH

SEQ ID NO: 1190 - protein, 128 aa, Artificial Sequence
  Description of Artificial Sequence: Synthetic polypeptide
CGANQFTCHNTNICISQAWVCDGVDDCEDNSDEKNCSAPASEPPGSLGGGGSGGGGSGGGGSCQPDEFTCSSGRCIPQPWLCDGLNDCGDGSDEPPAHCSAPASEPPGSLSLQKASGALEHHHHHHHH

SEQ ID NO: 1191 - protein, 113 aa, Artificial Sequence
  Description of Artificial Sequence: Synthetic polypeptide
CQPDEFTCSSGRCIPQPWLCDGLNDCGDGSDEPPAHCSAPASEPPGSLCGANQFTCHNTNICISQAWVCDGVDDCEDNSDEKNCSAPASEPPGSLSLQKASGALEHHHHHHHH

SEQ ID NO: 1192 - protein, 120 aa, Artificial Sequence
  Description of Artificial Sequence: Synthetic polypeptide
CQPDEFTCSSGRCIPQPWLCDGLNDCGDGSDEPPAHCSAPASEPPGSLSLGGGGSCGANQFTCHNTNICISQAWVCDGVDDCEDNSDEKNCSAPASEPPGSLSLQKASGALEHHHHHHHH

SEQ ID NO: 1193 - protein, 125 aa, Artificial Sequence
  Description of Artificial Sequence: Synthetic polypeptide
CQPDEFTCSSGRCIPQPWLCDGLNDCGDGSDEPPAHCSAPASEPPGSLSLGGGGSGGGGSCGANQFTCHNTNICISQAWVCDGVDDCEDNSDEKNCSAPASEPPGSLSLQKASGALEHHHHHHHH

SEQ ID NO: 1194 - protein, 132 aa, Artificial Sequence
  Description of Artificial Sequence: Synthetic polypeptide
CQPDEFTCSSGRCIPQPWLCDGLNDCGDGSDEPPAHCSAPASEPPGSLSLGGGGSGGGGSGGGGLFMCGANQFTCHNTNICISQAWVCDGVDDCEDNSDEKNCSAPASEPPGSLSLQKASGALEHHHHHHHH

SEQ ID NO: 1195 - protein, 116 aa, Artificial Sequence
  Description of Artificial Sequence: Synthetic polypeptide
CGANQFTCHNTNICISQAWVCDGVDDCEDNSDEKNCSAPASEPPGSLCHSFNQFECRNGQCIPLHLVCDGVPDCGDNSDETDCGDSHILPFSTPGPSTSLQKASGALEHHHHHHHH

SEQ ID NO: 1196 - protein, 121 aa, Artificial Sequence
  Description of Artificial Sequence: Synthetic polypeptide
CGANQFTCHNTNICISQAWVCDGVDDCEDNSDEKNCSAPASEPPGSLGGGGSCHSFNQFECRNGQCIPLHLVCDGVPDCGDNSDETDCGDSHILPFSTPGPSTSLQKASGALEHHHHHHHH

SEQ ID NO: 1197 - protein, 126 aa, Artificial Sequence
  Description of Artificial Sequence: Synthetic polypeptide
CGANQFTCHNTNICISQAWVCDGVDDCEDNSDEKNCSAPASEPPGSLGGGGSGGGGSCHSFNQFECRNGQCIPLHLVCDGVPDCGDNSDETDCGDSHILPFSTPGPSTSLQKASGALEHHHHHHHH

SEQ ID NO: 1198 - protein, 131 aa, Artificial Sequence
  Description of Artificial Sequence: Synthetic polypeptide
CGANQFTCHNTNICISQAWVCDGVDDCEDNSDEKNCSAPASEPPGSLGGGGSGGGGSGGGGSCHSFNQFECRNGQCIPLHLVCDGVPDCGDNSDETDCGDSHILPFSTPGPSTSLQKASGALEHHHHHHHH

SEQ ID NO: 1199 - protein, 116 aa, Artificial Sequence
  Description of Artificial Sequence: Synthetic polypeptide
CHSFNQFECRNGQCIPLHLVCDGVPDCGDNSDETDCGDSHILPFSTPGPSTCGANQFTCHNTNICISQAWVCDGVDDCEDNSDEKNCSAPASEPPGSLSLQKASGALEHHHHHHHH

SEQ ID NO: 1200 - protein, 121 aa, Artificial Sequence
  Description of Artificial Sequence: Synthetic polypeptide
CHSFNQFECRNGQCIPLHLVCDGVPDCGDNSDETDCGDSHILPFSTPGPSTGGGGSCGANQFTCHNTNICISQAWVCDGVDDCEDNSDEKNCSAPASEPPGSLSLQKASGALEHHHHHHHH

SEQ ID NO: 1201 - protein, 175 aa, Artificial Sequence
  Description of Artificial Sequence: Synthetic polypeptide
MAGPAYPYDVPDYAPGLEASGGSCGAGLFTCRSTKICISQAWVCDGVDDCEDNSDEKNCSAPASEPPGSLCLPDEFQCGSGRCIPQHWLCDGLNDCGDGSDEPPAHCSAPASEPPGSLCRAGEFRCSNGRCVPLTWLCDGEDDCQDNSDEKNCAQPTSLQKASGALEHHHHHHHH

SEQ ID NO: 1202 - protein, 175 aa, Artificial Sequence
  Description of Artificial Sequence: Synthetic polypeptide
MAGPAYPYDVPDYAPGLEASGGSCGAGLFTCRSTKICISQAWVCDGVDDCEDNSDEKNCSAPASEPPGSLCLPDEFQCSSGRCIPQTWVCDGLNDCGDGSDESPAHCSQDPEFHKVCPSSEFRCNNGRCIPLHWVCDGDDDCQDNSDETDCERSGRTSLQKASGALEHHHHHHHH

SEQ ID NO: 1203 - protein, 175 aa, Artificial Sequence
  Description of Artificial Sequence: Synthetic polypeptide
MAGPAYPYDVPDYAPGLEASGGSCLPDEFQCSSGRCIPQTWVCDGLNDCGDGSDESPAHCSQDPEFHKVCPSSEFRCNNGRCIPLHWVCDGDDDCQDNSDETDCERSGRTCGAGLFTCRSTKICISQAWVCDGVDDCEDNSDEKNCSAPASEPPGSLSLQKASGALEHHHHHHHH

SEQ ID NO: 1204 - protein, 177 aa, Artificial Sequence
  Description of Artificial Sequence: Synthetic polypeptide
MAGPAYPYDVPDYAPGLEASGGSCGAGLFTCRSTKICISQAWVCDGVDDCEDNSDEKNCSAPASEPPGSLCGPDEFRCNNGQCIPLPWRCDGVDDCGDNSDEPLEICQAPTCQSNEFRCRSGRCIPQHWLCDGLNDCGDGSDEPPAHCSAPASEPPGSLSLQKASGALEHHHHHHHH

SEQ ID NO: 1205 - protein, 173 aa, Artificial Sequence
  Description of Artificial Sequence: Synthetic polypeptide
MAGPAYPYDVPDYAPGLEASGGSCGAGQFTCRDTNICISRAWRCDGVDDCEDNSDEADCSQDPEFHKVCLPDEFQCGSGRCIPQHWLCDGLNDCGDGSDEPPAHCSAPASEPPGSLCRAGEFRCSNGRCVPLTWLCDGEDDCQDNSDEKNCAQPTSLQKASGALEHHHHHHHH

SEQ ID NO: 1206 - protein, 173 aa, Artificial Sequence
  Description of Artificial Sequence: Synthetic polypeptide
MAGPAYPYDVPDYAPGLEASGGSCLPDEFQCGSGRCIPQHWLCDGLNDCGDGSDEPPAHCSAPASEPPGSLCRAGEFRCSNGRCVPLTWLCDGEDDCQDNSDEKNCAQPTCGAGQFTCRDTNICISRAWRCDGVDDCEDNSDEADCSQDPEFHKVSLQKASGALEHHHHHHHH

SEQ ID NO: 1207 - protein, 173 aa, Artificial Sequence
  Description of Artificial Sequence: Synthetic polypeptide
MAGPAYPYDVPDYAPGLEASGGSCGAGQFTCRDTNICISRAWRCDGVDDCEDNSDEADCSQDPEFHKVCLPDEFQCSSGRCIPQTWVCDGLNDCGDGSDESPAHCSQDPEFHKVCPSSEFRCNNGRCIPLHWVCDGDDDCQDNSDETDCERSGRTSLQKASGALEHHHHHHHH

SEQ ID NO: 1208 - protein, 173 aa, Artificial Sequence
  Description of Artificial Sequence: Synthetic polypeptide
MAGPAYPYDVPDYAPGLEASGGSCLPDEFQCSSGRCIPQTWVCDGLNDCGDGSDESPAHCSQDPEFHKVCPSSEFRCNNGRCIPLHWVCDGDDDCQDNSDETDCERSGRTCGAGQFTCRDTNICISRAWRCDGVDDCEDNSDEADCSQDPEFHKVSLQKASGALEHHHHHHHH

SEQ ID NO: 1209 - protein, 175 aa, Artificial Sequence
  Description of Artificial Sequence: Synthetic polypeptide
MAGPAYPYDVPDYAPGLEASGGSCGAGQFTCRDTNICISRAWRCDGVDDCEDNSDEADCSQDPEFHKVCGPDEFRCNNGQCIPLPWRCDGVDDCGDNSDEPLEICQAPTCQSNEFRCRSGRCIPQHWLCDGLNDCGDGSDEPPAHCSAPASEPPGSLSLQKASGALEHHHHHHHH

SEQ ID NO: 1210 - protein, 129 aa, Artificial Sequence
  Description of Artificial Sequence: Synthetic polypeptide
MAGPAYPYDVPDYAPGLEASGGSCGANQFTCHNTNICISQAWVCDGVDDCEDNSDEKNCSAPASEPPGSLCIAAKLCEALDGDGVCHKECDLEECDWDGGDCQRIFLTDPTSLQKASGALEHHHHHHHH

SEQ ID NO: 1211 - protein, 175 aa, Artificial Sequence
  Description of Artificial Sequence: Synthetic polypeptide
MAGPAYPYDVPDYAPGLEASGGSCGANQFTCHNTNICISQAWVCDGVDDCEDNSDEKNCSAPASEPPGSLCLPDEFQCGSGRCIPQHWLCDGLNDCGDGSDEPPAHCSAPASEPPGSLCRAGEFRCSNGRCVPLTWLCDGEDDCQDNSDEKNCAQPTSLQKASGALEHHHHHHHH

SEQ ID NO: 1212 - protein, 177 aa, Artificial Sequence
  Description of Artificial Sequence: Synthetic polypeptide
MAGPAYPYDVPDYAPGLEASGGSCLSDQFTCRSTNICLPLQWVCDGDDDCEDNSDEEDCSAPASEPPGSLCGPDEFRCNNGQCIPLPWRCDGVDDCGDNSDEPLEICQAPTCQSNEFRCRSGRCIPQHWLCDGLNDCGDGSDEPPAHCSAPASEPPGSLSLQKASGALEHHHHHHHH

SEQ ID NO: 1213 - protein, 175 aa, Artificial Sequence
  Description of Artificial Sequence: Synthetic polypeptide
MAGPAYPYDVPDYAPGLEASGGSCGANQFTCHNTNICISQAWVCDGVDDCEDNSDEKNCSAPASEPPGSLCLPDEFQCSSGRCIPQTWVCDGLNDCGDGSDESPAHCSQDPEFHKVCPSSEFRCNNGRCIPLHWVCDGDDDCQDNSDETDCERSGRTSLQKASGALEHHHHHHHH

SEQ ID NO: 1214 - protein, 175 aa, Artificial Sequence
  Description of Artificial Sequence: Synthetic polypeptide
MAGPAYPYDVPDYAPGLEASGGSCLPDEFQCSSGRCIPQTWVCDGLNDCGDGSDESPAHCSQDPEFHKVCPSSEFRCNNGRCIPLHWVCDGDDDCQDNSDETDCERSGRTCGANQFTCHNTNICISQAWVCDGVDDCEDNSDEKNCSAPASEPPGSLSLQKASGALEHHHHHHHH

SEQ ID NO: 1215 - protein, 177 aa, Artificial Sequence
  Description of Artificial Sequence: Synthetic polypeptide
MAGPAYPYDVPDYAPGLEASGGSCGANQFTCHNTNICISQAWVCDGVDDCEDNSDEKNCSAPASEPPGSLCGPDEFRCNNGQCIPLPWRCDGVDDCGDNSDEPLEICQAPTCQSNEFRCRSGRCIPQHWLCDGLNDCGDGSDEPPAHCSAPASEPPGSLSLQKASGALEHHHHHHHH

SEQ ID NO: 1216 - protein, 173 aa, Artificial Sequence
  Description of Artificial Sequence: Synthetic polypeptide
MAGPAYPYDVPDYAPGLEASGGSCLPDEFQCGSGRCIPQHWLCDGLNDCGDGSDEPPAHCSAPASEPPGSLCRAGEFRCSNGRCVPLTWLCDGEDDCQDNSDEKNCAQPTCGSNQFTCRSTNICISQAWVCDGVDDCEDDSDETGCSQDPEFHKVSLQKASGALEHHHHHHHH

SEQ ID NO: 1217 - protein, 173 aa, Artificial Sequence
  Description of Artificial Sequence: Synthetic polypeptide
MAGPAYPYDVPDYAPGLEASGGSCGSNQFTCRSTNICISQAWVCDGVDDCEDDSDETGCSQDPEFHKVCLPDEFQCSSGRCIPQTWVCDGLNDCGDGSDESPAHCSQDPEFHKVCPSSEFRCNNGRCIPLHWVCDGDDDCQDNSDETDCERSGRTSLQKASGALEHHHHHHHH

SEQ ID NO: 1218 - protein, 173 aa, Artificial Sequence
  Description of Artificial Sequence: Synthetic polypeptide
MAGPAYPYDVPDYAPGLEASGGSCLPDEFQCSSGRCIPQTWVCDGLNDCGDGSDESPAHCSQDPEFHKVCPSSEFRCNNGRCIPLHWVCDGDDDCQDNSDETDCERSGRTCGSNQFTCRSTNICISQAWVCDGVDDCEDDSDETGCSQDPEFHKVSLQKASGALEHHHHHHHH

SEQ ID NO: 1219 - protein, 129 aa, Artificial Sequence
  Description of Artificial Sequence: Synthetic polypeptide
MAGPAYPYDVPDYAPGLEASGGSCLSDQFTCRSTNICLPLQWVCDGDDDCEDNSDEEDCSAPASEPPGSLCIAAKLCEALDGDGVCHKECDLEECDWDGGDCQRIFLTDPTSLQKASGALEHHHHHHHH

SEQ ID NO: 1220 - protein, 129 aa, Artificial Sequence
  Description of Artificial Sequence: Synthetic polypeptide
MAGPAYPYDVPDYAPGLEASGGSCIAAKLCEALDGDGVCHKECDLEECDWDGGDCQRIFLTDPTCLSDQFTCRSTNICLPLQWVCDGDDDCEDNSDEEDCSAPASEPPGSLSLQKASGALEHHHHHHHH

SEQ ID NO: 1221 - protein, 175 aa, Artificial Sequence
  Description of Artificial Sequence: Synthetic polypeptide
MAGPAYPYDVPDYAPGLEASGGSCLPDEFQCGSGRCIPQHWLCDGLNDCGDGSDEPPAHCSAPASEPPGSLCRAGEFRCSNGRCVPLTWLCDGEDDCQDNSDEKNCAQPTCLSDQFTCRSTNICLPLQWVCDGDDDCEDNSDEEDCSAPASEPPGSLSLQKASGALEHHHHHHHH

SEQ ID NO: 1222 - protein, 175 aa, Artificial Sequence
  Description of Artificial Sequence: Synthetic polypeptide
MAGPAYPYDVPDYAPGLEASGGSCLSDQFTCRSTNICLPLQWVCDGDDDCEDNSDEEDCSAPASEPPGSLCLPDEFQCSSGRCIPQTWVCDGLNDCGDGSDESPAHCSQDPEFHKVCPSSEFRCNNGRCIPLHWVCDGDDDCQDNSDETDCERSGRTSLQKASGALEHHHHHHHH

SEQ ID NO: 1223 - protein, 175 aa, Artificial Sequence
  Description of Artificial Sequence: Synthetic polypeptide
MAGPAYPYDVPDYAPGLEASGGSCLPDEFQCSSGRCIPQTWVCDGLNDCGDGSDESPAHCSQDPEFHKVCPSSEFRCNNGRCIPLHWVCDGDDDCQDNSDETDCERSGRTCLSDQFTCRSTNICLPLQWVCDGDDDCEDNSDEEDCSAPASEPPGSLSLQKASGALEHHHHHHHH

SEQ ID NO: 1224 - protein, 182 aa, Artificial Sequence
  Description of Artificial Sequence: Synthetic polypeptide
MAGPAYPYDVPDYAPGLEASGGSCLSDQFTCRSTNICLPLQWVCDGDDDCEDNSDEEDCSAPASEPPGSLCASNQFRCGNGHCLSRTWLCDGVNDCEDGSDEADCSAPASEPPGSLCPPSQFTCGNGRCVSLGWVCDGLNDCGDGSDESPALCSAPASEPPGSLSLQKASGALEHHHHHHHH

SEQ ID NO: 1225 - protein, 167 aa, Artificial Sequence
  Description of Artificial Sequence: Synthetic polypeptide
MAGPAYPYDVPDYAPGLEASGGSCRLNEFPCGSGSCISLHWVCDSVPDCRDDSDETDCPERTCLPDEFQCGSGRCIPQHWLCDGLNDCGDGSDEPPAHCSAPASEPPGSLCRAGEFRCSNGRCVPLTWLCDGEDDCQDNSDEKNCAQPTSLQKASGALEHHHHHHHH

SEQ ID NO: 1226 - protein, 167 aa, Artificial Sequence
  Description of Artificial Sequence: Synthetic polypeptide
MAGPAYPYDVPDYAPGLEASGGSCLPDEFQCGSGRCIPQHWLCDGLNDCGDGSDEPPAHCSAPASEPPGSLCRAGEFRCSNGRCVPLTWLCDGEDDCQDNSDEKNCAQPTCRLNEFPCGSGSCISLHWVCDSVPDCRDDSDETDCPERTSLQKASGALEHHHHHHHH

SEQ ID NO: 1227 - protein, 167 aa, Artificial Sequence
  Description of Artificial Sequence: Synthetic polypeptide
MAGPAYPYDVPDYAPGLEASGGSCRLNEFPCGSGSCISLHWVCDSVPDCRDDSDETDCPERTCLPDEFQCSSGRCIPQTWVCDGLNDCGDGSDESPAHCSQDPEFHKVCPSSEFRCNNGRCIPLHWVCDGDDDCQDNSDETDCERSGRTSLQKASGALEHHHHHHHH

SEQ ID NO: 1228 - protein, 167 aa, Artificial Sequence
  Description of Artificial Sequence: Synthetic polypeptide
MAGPAYPYDVPDYAPGLEASGGSCLPDEFQCSSGRCIPQTWVCDGLNDCGDGSDESPAHCSQDPEFHKVCPSSEFRCNNGRCIPLHWVCDGDDDCQDNSDETDCERSGRTCRLNEFPCGSGSCISLHWVCDSVPDCRDDSDETDCPERTSLQKASGALEHHHHHHHH

SEQ ID NO: 1229 - protein, 169 aa, Artificial Sequence
  Description of Artificial Sequence: Synthetic polypeptide
MAGPAYPYDVPDYAPGLEASGGSCRLNEFPCGSGSCISLHWVCDSVPDCRDDSDETDCPERTCGPDEFRCNNGQCIPLPWRCDGVDDCGDNSDEPLEICQAPTCQSNEFRCRSGRCIPQHWLCDGLNDCGDGSDEPPAHCSAPASEPPGSLSLQKASGALEHHHHHHHH

SEQ ID NO: 1230 - protein, 177 aa, Artificial Sequence
  Description of Artificial Sequence: Synthetic polypeptide
MAGPAYPYDVPDYAPGLEASGGSCAAGQFRCHNSDTCLPGAWVCDGDNDCGDNSDEASCQKRTCHSFNQFECRNGQCIPLHLVCDGVPDCGDNSDETDCGDSHILPFSTPGPSTCGAGQFTCRDTNICISRAWRCDGVDDCEDNSDEADCSQDPEFHKVSLQKASGALEHHHHHHHH

SEQ ID NO: 1231 - protein, 173 aa, Artificial Sequence
  Description of Artificial Sequence: Synthetic polypeptide
MAGPAYPYDVPDYAPGLEASGGSCAPDQFRCSSGQCIPETWLCDGDDDCVDSSDEAGCASTVPTCLPDEFQCGSGRCIPQTWVCDGLNDCGDGSDESPAHCSQDPEFHKVCGAGQFTCRDTNICISRAWRCDGVDDCEDNSDEADCSQDPEFHKVSLQKASGALEHHHHHHHH

SEQ ID NO: 1232 - protein, 175 aa, Artificial Sequence
  Description of Artificial Sequence: Synthetic polypeptide
MAGPAYPYDVPDYAPGLEASGGSCLPDEFQCGSGRCIPQHWLCDGLNDCGDGSDEPPAHCSAPASEPPGSLCRAGEFRCSNGRCVPLTWLCDGEDDCQDNSDEKNCAQPTCGANQFTCHNTNICISQAWVCDGVDDCEDNSDEKNCSAPASEPPGSLSLQKASGALEHHHHHHHH

SEQ ID NO: 1233 - protein, 175 aa, Artificial Sequence
  Description of Artificial Sequence: Synthetic polypeptide
MAGPAYPYDVPDYAPGLEASGGSCGANQFTCHNTNICISQAWVCDGVDDCEDNSDEKNCSAPASEPPGSLCLPDEFRCGNGNCISVAWRCDGVDDCEDGSDEEDCESPEHTCQSNEFRCRSGRCIPQHWLCDGLNDCGDGSDESPAHCSQDPEFHKVSLQKASGALEHHHHHHHH

SEQ ID NO: 1234 - protein, 175 aa, Artificial Sequence
  Description of Artificial Sequence: Synthetic polypeptide
MAGPAYPYDVPDYAPGLEASGGSCGANQFTCHNTNICISQAWVCDGVDDCEDNSDEKNCSAPASEPPGSLCAPDQFRCSSGQCIPETWLCDGDDDCVDSSDEAGCASTVPTCLPDEFQCGSGRCIPQTWVCDGLNDCGDGSDESPAHCSQDPEFHKVSLQKASGALEHHHHHHHH

SEQ ID NO: 1235 - protein, 41 aa, Artificial Sequence
  Description of Artificial Sequence: Synthetic polypeptide
CLSNQFQCDNGHCLSLTWRCDGYNDCGDSSDEENCAASEHT

SEQ ID NO: 1236 - protein, 37 aa, Artificial Sequence; identical to SEQ ID NO: 131
  Description of Artificial Sequence: Synthetic polypeptide

SEQ ID NO: 1237 - protein, 37 aa, Artificial Sequence
  Description of Artificial Sequence: Synthetic polypeptide
CLPDEFQCGSGRCIPQHWLCDGLNDCGDGSDEPPAHC

SEQ ID NO: 1238 - protein, 37 aa, Artificial Sequence
  Description of Artificial Sequence: Synthetic polypeptide
CLPDEFQCGSGRCIPQTWVCDGLNDCGDGSDESPATC

SEQ ID NO: 1239 - protein, 37 aa, Artificial Sequence
  Description of Artificial Sequence: Synthetic polypeptide
CQPDEFQCGSGRCIPQTWVCDGLNDCGDGSDESPAHC

SEQ ID NO: 1240 - protein, 41 aa, Artificial Sequence
  Description of Artificial Sequence: Synthetic polypeptide
  MOD_RES (2)..(3): Any amino acid
  MOD_RES (5)..(8): Any amino acid
  MOD_RES (10)..(10): Any amino acid
  MOD_RES (12)..(12): Any amino acid
  MOD_RES (15)..(18): Any amino acid
  MOD_RES (20)..(22): Any amino acid
  misc_feature (23)..(24): This region may encompass 0-2 residues
  MOD_RES (24)..(24): Any amino acid
  MOD_RES (25)..(28): Any amino acid
  MOD_RES (32)..(35): Any amino acid
  MOD_RES (37)..(39): Any amino acid
CXXCXXXXPXCXWCXXXXFXXXGXXXXXRCDXXXXLXXXGC

SEQ ID NO: 1241 - protein, 35 aa, Artificial Sequence
  Description of Artificial Sequence: Synthetic polypeptide
CSPSQLSCGSGECLSAERRCDLRPDCQDGSDEDGC

SEQ ID NO: 1242 - protein, 34 aa, Artificial Sequence
  Description of Artificial Sequence: Synthetic polypeptide
  MOD_RES (2)..(2): His, Asn, Pro or absent
  MOD_RES (3)..(3): Ala, Pro or absent
  MOD_RES (4)..(4): His, Ile, Lys, Leu, Met, Pro, Arg, Val or absent
  MOD_RES (5)..(5): Ala, Glu, Ile, Leu or Tyr
  MOD_RES (6)..(6): Ala, Asp, Glu, Gly, Gln, Arg or Tyr
  MOD_RES (7)..(7): Ala, Asp, Glu, His, Ile, Lys, Leu, Asn, Pro, Gln or Ser
  MOD_RES (8)..(8): Asp, His, Leu, Met, Ser or Tyr
  MOD_RES (10)..(10): Ala, Glu, Lys, Pro, Gln or Thr
  MOD_RES (11)..(11): Ala, Glu, His, Lys, Asn, Gln, Arg or Ser
  MOD_RES (12)..(12): Phe, Leu, Arg or Tyr
  MOD_RES (13)..(13): Asp, Glu, Val or Tyr
  MOD_RES (17)..(17): Asp, Glu, Gly, Ile, Lys, Asn, Arg, Ser or Val
  MOD_RES (19)..(19): Asp, Glu, Gly, His, Asn, Gln, Arg or Ser
  MOD_RES (20)..(20): Glu, Lys, Pro, Gln or Ser
  MOD_RES (21)..(21): Ala, Asp, Glu, Gly, His, Pro or Gln
  MOD_RES (23)..(23): Asp, Gly, Asn or Ser
  MOD_RES (24)..(24): Phe, Leu, Asn, Ser or Thr
  MOD_RES (25)..(25): Ala, Glu, Pro, Ser or Tyr
  MOD_RES (26)..(26): Ala, Glu, Gly, Lys, Arg or Thr
  MOD_RES (28)..(28): Ala, Asp, Gly, Ile, Leu, Asn, Ser or Val
  MOD_RES (32)..(32): Asp, Phe, Gly, Leu, Met or Val
  MOD_RES (33)..(33): Asp or Asn
CXXXXXXXCXXXXGDGXCXXXCXXXXCXWDGXXC

SEQ ID NO: 1243 - protein, 41 aa, Artificial Sequence
  Description of Artificial Sequence: Synthetic polypeptide
CIAAKLCEALDGDGVCHKECDLEECDWDGGDCQRIFLTDPT

SEQ ID NO: 1244 - protein, 43 aa, Artificial Sequence
  Description of Artificial Sequence: Synthetic polypeptide
CPPHIEDHCERRDGDGVCQKPCDFYGCLWDGVNCDMDLVQELT

SEQ ID NO: 1245 - protein, 43 aa, Artificial Sequence
  Description of Artificial Sequence: Synthetic polypeptide
CNPIIQHYCETYDGDGLCESACNFYGCAWDGFDCQVISDKDST

SEQ ID NO: 1246 - protein, 41 aa, Artificial Sequence
  Description of Artificial Sequence: Synthetic polypeptide
CMAYNLCTALVGDGECDQECDTPTCNWDGGDCAVKSAPDST

SEQ ID NO: 1247 - protein, 41 aa, Artificial Sequence
  Description of Artificial Sequence: Synthetic polypeptide
CMEAKSCQARDGDGDCGQGCNLAECIWDGMDCRPEWIRELT

SEQ ID NO: 1248 - protein, 43 aa, Artificial Sequence
  Description of Artificial Sequence: Synthetic polypeptide
CNPLYDDHCAAFFGDGGCGPECSLAECLWDGGDCEEERDADVT

SEQ ID NO: 1249 - protein, 40 aa, Artificial Sequence
  Description of Artificial Sequence: Synthetic polypeptide
CNDVKCKRLDGDGHASNLVTNAECLWDGLDCPDVVISDLT

SEQ ID NO: 1250 - protein, 41 aa, Artificial Sequence
  Description of Artificial Sequence: Synthetic polypeptide
CIAAKLCERLDGDGSCQSECGNATCGWDGMDCDEKENDELT

SEQ ID NO: 1251 - protein, 41 aa, Artificial Sequence
  Description of Artificial Sequence: Synthetic polypeptide
CMAYLLCKKYYGDGICRSECDTATCSWDGFDCPVNEIEDLT

SEQ ID NO: 1252 - protein, 43 aa, Artificial Sequence
  Description of Artificial Sequence: Synthetic polypeptide
CPPHIEDHCERRDGDGVCQKPCDFYGCLWDGVDCDMDLVEELT

SEQ ID NO: 1253 - protein, 41 aa, Artificial Sequence
  Description of Artificial Sequence: Synthetic polypeptide
CMAYNLCQALVGDGSCNSECDTETCGWDGMDCATVEGAEAT

SEQ ID NO: 1254 - protein, 41 aa, Artificial Sequence
  Description of Artificial Sequence: Synthetic polypeptide
CREYSMCTRFDGDGICHEQCGYPRCLWDGLDCANNFDHEVT

SEQ ID NO: 1255 - protein, 43 aa, Artificial Sequence
  Description of Artificial Sequence: Synthetic polypeptide
CNPLYDPHCRSYFGDGDCGPGCDLAACLWDGGDCPGVAAAELT

SEQ ID NO: 1256 - protein, 43 aa, Artificial Sequence
  Description of Artificial Sequence: Synthetic polypeptide
CHPLIREYCEKFFGDGGCDSGCNNSRCDWDGDDCGLIQHGDVT

SEQ ID NO: 1257 - protein, 43 aa, Artificial Sequence; identical to SEQ ID NO: 1248
  Description of Artificial Sequence: Synthetic polypeptide

SEQ ID NO: 1258 - protein, 43 aa, Artificial Sequence
  Description of Artificial Sequence: Synthetic polypeptide
CNPKYDAHCASYFGDGECDPACSLAECVWDGDDCDPNFLTDVT

SEQ ID NO: 1259 - protein, 43 aa, Artificial Sequence; identical to SEQ ID NO: 1252
  Description of Artificial Sequence: Synthetic polypeptide

SEQ ID NO: 1260 - protein, 43 aa, Artificial Sequence
  Description of Artificial Sequence: Synthetic polypeptide
CNPPIGQYCTQLFGDGDCGPDCDLAECVWDGDDCDPVAVPDVT

SEQ ID NO: 1261 - protein, 43 aa, Artificial Sequence
  Description of Artificial Sequence: Synthetic polypeptide
CNPVYDPYCAAFFGDGGCGPHCGLAECVWDGMDCDHKEVRELT

SEQ ID NO: 1262 - protein, 43 aa, Artificial Sequence
  Description of Artificial Sequence: Synthetic polypeptide
CHPLIREYCTHYDGDGECDKGCDSAKCKWDGDDCDMDVLAEVT

SEQ ID NO: 1263 - protein, 43 aa, Artificial Sequence; identical to SEQ ID NO: 1262
  Description of Artificial Sequence: Synthetic polypeptide

SEQ ID NO: 1264 - protein, 85 aa, Artificial Sequence
  Description of Artificial Sequence: Synthetic polypeptide
CLPDEFQCGSGRCIPQTWVCDGLNDCGDGSDESPAHCSQDPEFHKVCLPGQFPCGNGRCIPETWLCDGDDDCQDGSDEKGCAQPT

SEQ ID NO: 1265 - protein, 132 aa, Artificial Sequence
  Description of Artificial Sequence: Synthetic polypeptide
CLPDEFQCSSGRCIPQTWVCDGLNDCGDGSDESPAHCSQDPEFHKVCPSSEFRCNNGRCIPLHWVCDGDDDCQDNSDETDCAQPTCGEGLFTCRSTNICISHAWVCDGVDDCEDNSDENNCSAPASEPPGSL

SEQ ID NO: 1266 - protein, 132 aa, Artificial Sequence
  Description of Artificial Sequence: Synthetic polypeptide
CLPDEFQCGSGRCIPQTWVCDGLNDCGDGSDESPAHCSQDPEFHKVCRPGEFRCNNGRCVPQTWVCDGEDDCGDNSDETDCAQPTCGEGLFTCRSTNICISHAWVCDGVDDCEDNSDENNCSAPASEPPGSL

SEQ ID NO: 1267 - protein, 132 aa, Artificial Sequence
  Description of Artificial Sequence: Synthetic polypeptide
CLPDEFQCGSGRCIPQTWVCDGLNDCGDGSDESPAHCSQDPEFHKVCLSDQFRCGNGRCVPRAWLCDGDNDCQDGSDETNCEQPTCGEGLFTCRSTNICISHAWVCDGVDDCEDNSDENNCSAPASEPPGSL

SEQ ID NO: 1268 - protein, 132 aa, Artificial Sequence
  Description of Artificial Sequence: Synthetic polypeptide
CLPDEFQCGSGRCIPQTWVCDGLNDCGDGSDESPAHCSQDPEFHKVCLPGQFPCGNGRCIPETWLCDGDDDCQDGSDEKGCAQPTCGEGLFTCRSTNICISHAWVCDGVDDCEDNSDENNCSAPASEPPGSL

SEQ ID NO: 1269 - protein, 132 aa, Artificial Sequence
  Description of Artificial Sequence: Synthetic polypeptide
CLPDEFQCGSGRCIPQTWVCDGLNDCGDGSDESPAHCSQDPEFHKVCQSNEFRCRNGQCIPLTWLCDGDNDCLDSSDEESCPAHTCGEGLFTCRSTNICISHAWVCDGVDDCEDNSDENNCSAPASEPPGSL

SEQ ID NO: 1270 - protein, 136 aa, Artificial Sequence
  Description of Artificial Sequence: Synthetic polypeptide
CAPGEFTCKNTGRCIPLNWRCDGDDDCGDGSDETDCPAPTCPSNQFPCRSTGICIPLAWVCDGLNDCGDGSDESPAHCSAPASEPPGSLCGEGLFTCRSTNICISHAWVCDGVDDCEDNSDENNCSAPASEPPGSL

SEQ ID NO: 1271 - protein, 136 aa, Artificial Sequence
  Description of Artificial Sequence: Synthetic polypeptide
CGPDEFRCNNGQCIPLPWRCDGVDDCGDNSDEPLEICQAPTCQSNEFRCRSGRCIPQHWLCDGLNDCGDGSDEPPAHCSAPASEPPGSLCGEGLFTCRSTNICISHAWVCDGVDDCEDNSDENNCSAPASEPPGSL

SEQ ID NO: 1272 - protein, 147 aa, Artificial Sequence
  Description of Artificial Sequence: Synthetic polypeptide
CGANEFQCRSTGICVPVEWVCDGDNDCGDGSDEPPVCGDSHILPFSTPGPSTCQPDEFTCSSGRCIPQPWLCDGLNDCGDGSDEPPAHCSAPASEPPGSLCGEGLFTCRSTNICISHAWVCDGVDDCEDNSDENNCSAPASEPPGSL

SEQ ID NO: 1273 - protein, 134 aa, Artificial Sequence
  Description of Artificial Sequence: Synthetic polypeptide
CGEGLFTCRSTNICISHAWVCDGVDDCEDNSDENNCSAPASEPPGSLCLPDEFQCGSGRCIPQHWLCDGLNDCGDGSDEPPAHCSAPASEPPGSLCRAGEFRCSNGRCVPLTWLCDGEDDCQDNSDEKNCAQPT

SEQ ID NO: 1274 - protein, 88 aa, Artificial Sequence
  Description of Artificial Sequence: Synthetic polypeptide
CIAAKLCEALDGDGVCHKECDLEECDWDGGDCQRIFLTDPTCGEGLFTCRSTNICISHAWVCDGVDDCEDNSDENNCSAPASEPPGSL

SEQ ID NO: 1275 - protein, 88 aa, Artificial Sequence
  Description of Artificial Sequence: Synthetic polypeptide
CGEGLFTCRSTNICISHAWVCDGVDDCEDNSDENNCSAPASEPPGSLCIAAKLCEALDGDGVCHKECDLEECDWDGGDCQRIFLTDPT

SEQ ID NO: 1276 - protein, 41 aa, Artificial Sequence
  Description of Artificial Sequence: Synthetic polypeptide
CREYISCPNFYGDGRCQQDCNLAKCVWDGLDCADVWSEDLT

SEQ ID NO: 1277 - protein, 40 aa, Artificial Sequence
  Description of Artificial Sequence: Synthetic polypeptide
CLYQDCKEYYGDGNCSKGCNLAECLWDGGDCGTIFLADVT

SEQ ID NO: 1278 - protein, 43 aa, Artificial Sequence
  Description of Artificial Sequence: Synthetic polypeptide
CNPPIGQYCTQLFGDGDCGPECNLAECVWDGDDCDPVAVPELT

SEQ ID NO: 1279 - protein, 43 aa, Artificial Sequence
  Description of Artificial Sequence: Synthetic polypeptide
CPAHYGTHCEERDGDGKCHQGCDFATCDWDGMDCGMDLVRELT

SEQ ID NO: 1280 - protein, 34 aa, Artificial Sequence; identical to SEQ ID NO: 1242
  Description of Artificial Sequence: Synthetic polypeptide
  MOD_RES (2)..(2): His, Asn, Pro or absent
  MOD_RES (3)..(3): Ala, Pro or absent
  MOD_RES (4)..(4): His, Ile, Lys, Leu, Met, Pro, Arg, Val or absent
  MOD_RES (5)..(5): Ala, Glu, Ile, Leu or Tyr
  MOD_RES (6)..(6): Ala, Asp, Glu, Gly, Gln, Arg or Tyr
  MOD_RES (7)..(7): Ala, Asp, Glu, His, Ile, Lys, Leu, Asn, Pro, Gln or Ser
  MOD_RES (8)..(8): Asp, His, Leu, Met, Ser or Tyr
  MOD_RES (10)..(10): Ala, Glu, Lys, Pro, Gln or Thr
  MOD_RES (11)..(11): Ala, Glu, His, Lys, Asn, Gln, Arg or Ser
  MOD_RES (12)..(12): Phe, Leu, Arg or Tyr
  MOD_RES (13)..(13): Asp, Phe, Val or Tyr
  MOD_RES (17)..(17): Asp, Glu, Gly, Ile, Lys, Asn, Arg, Ser or Val
  MOD_RES (19)..(19): Asp, Glu, Gly, His, Asn, Gln, Arg or Ser
  MOD_RES (20)..(20): Glu, Lys, Pro, Gln or Ser
  MOD_RES (21)..(21): Ala, Asp, Glu, Gly, His, Pro or Gln
  MOD_RES (23)..(23): Asp, Gly, Asn or Ser
  MOD_RES (24)..(24): Phe, Leu, Asn, Ser or Thr
  MOD_RES (25)..(25): Ala, Glu, Pro, Ser or Tyr
  MOD_RES (26)..(26): Ala, Glu, Gly, Lys, Arg or Thr
  MOD_RES (28)..(28): Ala, Asp, Gly, Ile, Leu, Asn, Ser or Val
  MOD_RES (32)..(32): Asp, Phe, Gly, Leu, Met or Val
  MOD_RES (33)..(33): Asp or Asn

SEQ ID NO: 1281 - protein, 9 aa, Artificial Sequence
  Description of Artificial Sequence: Synthetic peptide
  MOD_RES (1)..(1): Ala, Asp, Glu, Gly, Pro, Gln or Arg
  MOD_RES (2)..(2): Asp, Glu, His, Leu, Met, Pro, Arg, Thr or Val
  MOD_RES (3)..(3): Asp, Glu, Ile, Lys, Asn or Val
  MOD_RES (4)..(4): Ala, Glu, Phe, Leu, Gln, Arg, Ser, Val or Trp
  MOD_RES (5)..(5): Ala, Asp, Gly, His, Ile, Leu, Asn, Ser or Val
  MOD_RES (6)..(6): Ala, Asp, Glu, Gly, His, Pro, Gln, Arg or Thr
  MOD_RES (7)..(7): Asp or Glu
  MOD_RES (8)..(8): Ala, Leu, Pro, Ser or Val
XXXXXXXXT

SEQ ID NO: 1282 - protein, 733 aa, Artificial Sequence
  Description of Artificial Sequence: Synthetic polypeptide
SGGSCLPDEFQCGSGRCIPQHWLCDGLNDCGDGSDEPPAHCSAPASEPPGSLCRAGEFRCSNGRCVPLTWLCDGEDDCQDNSDEKNCAQPTCGEGLFTCRSTNICISHAWVCDGVDDCEDNSDENNCSAPASEPPGSLGGGGSGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 1283 - protein, 735 aa, Artificial Sequence
  Description of Artificial Sequence: Synthetic polypeptide
SGGSCAPGEFTCKNTGRCIPLNWRCDGDDDCGDGSDETDCPAPTCPSNQFPCRSTGICIPLAWVCDGLNDCGDGSDESPAHCSAPASEPPGSLCGEGLFTCRSTNICISHAWVCDGVDDCEDNSDENNCSAPASEPPGSLGGGGSGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 1284 - protein, 735 aa, Artificial Sequence [sequence omitted]

SEQ ID NO: 1285 - protein, 739 aa, Artificial Sequence
  Description of Artificial Sequence: Synthetic polypeptide
SGGSCGADQFRCGNGSCVPRAWRCDGVDDCGDGSDEAPEICETPTCQSNEFRCRSGRCIPQHWLCDGLNDCGDGSDESQQCSAPASEPPGSLCGEGLFTCRSTNICISHAWVCDGVDDCEDNSDENNCSAPASEPPGSLGGGGSGGGGSGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 1286 - protein, 744 aa, Artificial Sequence
  Description of Artificial Sequence: Synthetic polypeptide
SGGSCGADQFRCGNGSCVPRAWRCDGVDDCGDGSDEAPEICETPTCQSNEFRCRSGRCIPQHWLCDGLNDCGDGSDESQQCSAPASEPPGSLCGEGLFTCRSTNICISHAWVCDGVDDCEDNSDENNCSAPASEPPGSLGGGGSGGGGSGGGGSGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 1287 - protein, 3 aa, Artificial Sequence
  Description of Artificial Sequence: Synthetic peptide
  MOD_RES (2)..(2): Any amino acid except Pro
  MOD_RES (3)..(3): Ser or Thr
NXX

SEQ ID NO: 1288 - protein, 734 aa, Artificial Sequence
  Description of Artificial Sequence: Synthetic polypeptide
SGGSCGADQFRCGSGSCVPRAWRCDGVDDCGDGSDEAPEICETPTCQSNEFRCRSGRCIPQHWLCDGLNDCGDGSDESQQCSAPAGEPPGSLCGEGLFTCRSTNICISHAWVCDGVDDCEDNSDENNCSAPASEPPGSLGGGGSGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 1289 - protein, 734 aa, Artificial Sequence
  Description of Artificial Sequence: Synthetic polypeptide
SGGSCGADQFRCGNGQCVPRAWRCDGVDDCGDGSDEAPEICETPTCQSNEFRCRSGRCIPQHWLCDGLNDCGDGSDESQQCSAPAGEPPGSLCGEGLFTCRSTNICISHAWVCDGVDDCEDNSDENNCSAPASEPPGSLGGGGSGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 1290 - protein, 734 aa, Artificial Sequence
  Description of Artificial Sequence: Synthetic polypeptide
SGGSCGADQFRCGNGNCVPRAWRCDGVDDCGDGSDEAPEICETPTCQSNEFRCRSGRCIPQHWLCDGLNDCGDGSDESQQCSAPAGEPPGSLCGEGLFTCRSTNICISHAWVCDGVDDCEDNSDENNCSAPASEPPGSLGGGGSGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 1291 - protein, 734 aa, Artificial Sequence
  Description of Artificial Sequence: Synthetic polypeptide
SGGSCGADQFRCGNGGCVPRAWRCDGVDDCGDGSDEAPEICETPTCQSNEFRCRSGRCIPQHWLCDGLNDCGDGSDESQQCSAPAGEPPGSLCGEGLFTCRSTNICISHAWVCDGVDDCEDNSDENNCSAPASEPPGSLGGGGSGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 1292 - protein, 35 aa, Artificial Sequence
  Description of Artificial Sequence: Synthetic polypeptide
GGGGSGGGGSGGGGSGGGGSGGGGSGGGGSGGGGS

SEQ ID NO: 1293 - protein, 494 aa, Artificial Sequence
  Description of Artificial Sequence: Synthetic polypeptide
ERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGGGGGSGGGGSGGGGSGGGGSGGGGSGGGGSGGGGSGGGGSERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 1294 - protein, 644 aa, Artificial Sequence
  Description of Artificial Sequence: Synthetic polypeptide
SGGSCGADQFRCGNGSCVPRAWRCDGVDDCGDGSDEAPEICETPTCQSNEFRCRSGRCIPQHWPCDGLNDCGDGSDESQQCSAPASEPPGSLCGEGLFTCRSTNICISHAWVCDGVDDCEDNSDENNCSAPASEPPGSLASGGGGSGGGGERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGGGGGSGGGGSGGGGSGGGGSGGGGSGGGGSGGGGSGGGGSERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 1295 - protein, 643 aa, Artificial Sequence
  Description of Artificial Sequence: Synthetic polypeptide
SGGSCLPDEFQCGSGRCIPQHWLCDGLNDCGDGSDEPPAHCSAPASEPPGSLCRAGEFRCSNGRCVPLTWLCDGEDDCQDNSDEKNCAQPTCGEGLFTCRSTNICISHAWVCDGVDDCEDNSDENNCSAPASEPPGSLASGGGGSGGGGERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGGGGGSGGGGSGGGGSGGGGSGGGGSGGGGSGGGGSGGGGSERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 1296 - protein, 645 aa, Artificial Sequence
  Description of Artificial Sequence: Synthetic polypeptide
SGGSCAPGEFTCKNTGRCIPLNWRCDGDDDCGDGSDETDCPAPTCPSNQFPCRSTGICIPLAWVCDGLNDCGDGSDESPAHCSAPASEPPGSLCGEGLFTCRSTNICISHAWVCDGVDDCEDNSDENNCSAPASEPPGSLASGGGGSGGGGERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGGGGGSGGGGSGGGGSGGGGSGGGGSGGGGSGGGGSGGGGSERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 1297 - protein, 645 aa, Artificial Sequence
  Description of Artificial Sequence: Synthetic polypeptide
SGGSCGPDEFRCNNGQCIPLPWRCDGVDDCGDNSDEPLEICQAPTCQSNEFRCRSGRCIPQHWLCDGLNDCGDGSDEPPAHCSAPASEPPGSLCGEGLFTCRSTNICISHAWVCDGVDDCEDNSDENNCSAPASEPPGSLASGGGGSGGGGERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGGGGGSGGGGSGGGGSGGGGSGGGGSGGGGSGGGGSGGGGSERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 1298 - protein, 11 aa, Artificial Sequence
  Description of Artificial Sequence: Synthetic peptide
ASGGGGSGGGG

SEQ ID NO: 1299 - protein, 61 aa, Artificial Sequence
  Description of Artificial Sequence: Synthetic polypeptide
CPPHIEDHCERRDGDGVCQKPCDFYGCLWDGVNCDMDLVQELTSLQKASGALEHHHHHHHH

SEQ ID NO: 1300 - protein, 61 aa, Artificial Sequence
  Description of Artificial Sequence: Synthetic polypeptide
CNPIIQHYCETYDGDGLCESACNFYGCAWDGFDCQVISDKDSTSLQKASGALEHHHHHHHH

SEQ ID NO: 1301 - protein, 59 aa, Artificial Sequence
  Description of Artificial Sequence: Synthetic polypeptide
CMAYNLCTALVGDGECDQECDTPTCNWDGGDCAVKSAPDSTSLQKASGALEHHHHHHHH

SEQ ID NO: 1302 - protein, 59 aa, Artificial Sequence
  Description of Artificial Sequence: Synthetic polypeptide
CMEAKSCQARDGDGDCGQGCNLAECIWDGMDCRPEWIRELTSLQKASGALEHHHHHHHH

SEQ ID NO: 1303 - protein, 61 aa, Artificial Sequence
  Description of Artificial Sequence: Synthetic polypeptide
CNPLYDDHCAAFFGDGGCGPECSLAECLWDGGDCEEERDADVTSLQKASGALEHHHHHHHH

SEQ ID NO: 1304 - protein, 58 aa, Artificial Sequence
  Description of Artificial Sequence: Synthetic polypeptide
CNDVKCKRLDGDGHASNLVTNAECLWDGLDCPDVVISDLTSLQKASGALEHHHHHHHH

SEQ ID NO: 1305 - protein, 59 aa, Artificial Sequence
  Description of Artificial Sequence: Synthetic polypeptide
CIAAKLCERLDGDGSCQSECGNATCGWDGMDCDEKENDELTSLQKASGALEHHHHHHHH

SEQ ID NO: 1306 - protein, 59 aa, Artificial Sequence
  Description of Artificial Sequence: Synthetic polypeptide
CMAYLLCKKYYGDGICRSECDTATCSWDGFDCPVNEIEDLTSLQKASGALEHHHHHHHH

SEQ ID NO: 1307 - protein, 61 aa, Artificial Sequence
  Description of Artificial Sequence: Synthetic polypeptide
CPPHIEDHCERRDGDGVCQKPCDFYGCLWDGVDCDMDLVEELTSLQKASGALEHHHHHHHH

SEQ ID NO: 1308 - protein, 59 aa, Artificial Sequence
  Description of Artificial Sequence: Synthetic polypeptide
CMAYNLCQALVGDGSCNSECDTETCGWDGMDCATVEGAEATSLQKASGALEHHHHHHHH

SEQ ID NO: 1309 - protein, 59 aa, Artificial Sequence
  Description of Artificial Sequence: Synthetic polypeptide
CREYSMCTRFDGDGICHEQCGYPRCLWDGLDCANNFDHEVTSLQKASGALEHHHHHHHH

SEQ ID NO: 1310 - protein, 61 aa, Artificial Sequence
  Description of Artificial Sequence: Synthetic polypeptide
CNPLYDPHCRSYFGDGDCGPGCDLAACLWDGGDCPGVAAAELTSLQKASGALEHHHHHHHH

SEQ ID NO: 1311 - protein, 61 aa, Artificial Sequence
  Description of Artificial Sequence: Synthetic polypeptide
CHPLIREYCEKFFGDGGCDSGCNNSRCDWDGDDCGLIQHGDVTSLQKASGALEHHHHHHHH

SEQ ID NO: 1312 - protein, 61 aa, Artificial Sequence; identical to SEQ ID NO: 1303
  Description of Artificial Sequence: Synthetic polypeptide

SEQ ID NO: 1313 - protein, 61 aa, Artificial Sequence
  Description of Artificial Sequence: Synthetic polypeptide
CNPKYDAHCASYFGDGECDPACSLAECVWDGDDCDPNFLTDVTSLQKASGALEHHHHHHHH

SEQ ID NO: 1314 - protein, 61 aa, Artificial Sequence; identical to SEQ ID NO: 1307
  Description of Artificial Sequence: Synthetic polypeptide

SEQ ID NO: 1315 - protein, 61 aa, Artificial Sequence
  Description of Artificial Sequence: Synthetic polypeptide
CNPPIGQYCTQLFGDGDCGPDCDLAECVWDGDDCDPVAVPDVTSLQKASGALEHHHHHHHH

SEQ ID NO: 1316 - protein, 61 aa, Artificial Sequence
  Description of Artificial Sequence: Synthetic polypeptide
CNPVYDPYCAAFFGDGGCGPHCGLAECVWDGMDCDHKEVRELTSLQKASGALEHHHHHHHH

SEQ ID NO: 1317 - protein, 61 aa, Artificial Sequence
  Description of Artificial Sequence: Synthetic polypeptide
CHPLIREYCTHYDGDGECDKGCDSAKCKWDGDDCDMDVLAEVTSLQKASGALEHHHHHHHH

SEQ ID NO: 1318 - protein, 61 aa, Artificial Sequence; identical to SEQ ID NO: 1317
  Description of Artificial Sequence: Synthetic polypeptide

SEQ ID NO: 1319 - protein, 4 aa, Artificial Sequence
  Description of Artificial Sequence: Synthetic peptide
EPTP

SEQ ID NO: 1320 - protein, 4 aa, Artificial Sequence
  Description of Artificial Sequence: Synthetic peptide
PAPT

SEQ ID NO: 1321 - protein, 4 aa, Artificial Sequence
  Description of Artificial Sequence: Synthetic peptide
QAPT

SEQ ID NO: 1322 - protein, 4 aa, Artificial Sequence
  Description of Artificial Sequence: Synthetic peptide
AQPT

SEQ ID NO: 1323 - protein, 35 aa, Artificial Sequence; identical to SEQ ID NO: 218
  Description of Artificial Sequence: Synthetic polypeptide

SEQ ID NO: 1324 - protein, 38 aa, Artificial Sequence
  Description of Artificial Sequence: Synthetic polypeptide
CPSNQFPCRSTGICIPLAWVCDGLNDCGDGSDESPAHC

SEQ ID NO: 1325 - protein, 37 aa, Artificial Sequence
  Description of Artificial Sequence: Synthetic polypeptide
CQSNEFRCRSGRCIPQHWLCDGLNDCGDGSDEPPAHC

SEQ ID NO: 1326 - protein, 37 aa, Artificial Sequence; identical to SEQ ID NO: 1237
  Description of Artificial Sequence: Synthetic polypeptide

SEQ ID NO: 1327 - protein, 36 aa, Artificial Sequence; identical to SEQ ID NO: 250
  Description of Artificial Sequence: Synthetic polypeptide

SEQ ID NO: 1328 - protein, 37 aa, Artificial Sequence; identical to SEQ ID NO: 258
  Description of Artificial Sequence: Synthetic polypeptide

SEQ ID NO: 1329 - protein, 36 aa, Artificial Sequence; identical to SEQ ID NO: 159
  Description of Artificial Sequence: Synthetic polypeptide

SEQ ID NO: 1330 - protein, 37 aa, Artificial Sequence
  Description of Artificial Sequence: Synthetic polypeptide
CLPDEFQCSSGRCIPQTWVCDGLNDCGDGSDESPAHC

SEQ ID NO: 1331 - protein, 729 aa, Artificial Sequence
  Description of Artificial Sequence: Synthetic polypeptide
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGGSGGGGSCLPDEFQCGSGRCIPQHWLCDGLNDCGDGSDEPPAHCSAPASEPPGSLCRAGEFRCSNGRCVPLTWLCDGEDDCQDNSDEKNCAQPTCGEGLFTCRSTNICISHAWVCDGVDDCEDNSDENNCSAPASEPPGSL

SEQ ID NO: 1332 - protein, 731 aa, Artificial Sequence
  Description of Artificial Sequence: Synthetic polypeptide
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGGSGGGGSCAPGEFTCKNTGRCIPLNWRCDGDDDCGDGSDETDCPAPTCPSNQFPCRSTGICIPLAWVCDGLNDCGDGSDESPAHCSAPASEPPGSLCGEGLFTCRSTNICISHAWVCDGVDDCEDNSDENNCSAPASEPPGSL

SEQ ID NO: 1333 - protein, 731 aa, Artificial Sequence
  Description of Artificial Sequence: Synthetic polypeptide
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGGSGGGGSCGPDEFRCNNGQCIPLPWRCDGVDDCGDNSDEPLEICQAPTCQSNEFRCRSGRCIPQHWLCDGLNDCGDGSDEPPAHCSAPASEPPGSLCGEGLFTCRSTNICISHAWVCDGVDDCEDNSDENNCSAPASEPPGSL

What is claimed is:

1. A binding protein that selectively binds β-Klotho and Fibroblast Growth Factor Receptor 1c ("FGFR1c") comprising (a) one or more domains that selectively bind β-Klotho, and (b) one or more domains that selectively bind FGFR1c, wherein the binding protein comprises:
   (a) a β-Klotho binding domain comprising:

(SEQ ID NO: 257)
   CGADQFRCGNGSCVPRAWRCDGVDDCGDGSDEAPEIC;

(b) an FGFR1c binding domain comprising:

(SEQ ID NO: 108)
   CG[AE][GS]LFTC[GR][NRS][AST][KN]ICIS[EHQS][AV]W
   [IV]CDG[IV]DDC[DE]DNSDE[DKMNT][NSY]C, wherein the FGFR1c binding domain retains the ability to bind FGFR1c; and
   wherein amino acids in brackets indicate alternative amino acids at a specified position and "–" indicates no amino acid at the specified position.

2. The binding protein of claim 1 further comprising at least one linker joining (a) and (b).

3. The binding protein of claim 2, wherein the linker comprises: SAPASEPPGSL (SEQ ID NO: 12).

4. The binding protein of claim 3, wherein the FGFR1c binding domain of (b) comprises one or more of:

(SEQ ID NO: 109)
   CGAGLFTCRS TNICISQVWV CDGVDDCEDN SDEDSC;

(SEQ ID NO: 110)
   CGAGLFTCRS TNICISQAWV CDGVDDCEDN SDENYC;

(SEQ ID NO: 111)
   CGAGLFTCRS TNICISQAWV CDGVDDCEDN SDETNC;

(SEQ ID NO: 112)
   CGEGLFTCGS TNICISSAWV CDGVDDCEDN SDENNC;

(SEQ ID NO: 113)
   CGEGLFTCRS TNICISHAWV CDGVDDCEDN SDENNC;

(SEQ ID NO: 114)
   CGEGLFTCRS TNICISEAWI CDGVDDCEDN SDEKNC;

(SEQ ID NO: 115)
   CGAGLFTCRS AKICISHAWV CDGIDDCEDN SDENNC;

(SEQ ID NO: 116)
   CGAGLFTCRN SKICISQAWV CDGVDDCDDN SDEKYC;

(SEQ ID NO: 117)
   CGASLFTCRR SNICISQAWV CDGVDDCEDN SDEMNC;
   and (SEQ ID NO: 118)
   CGAGLFTCRS TKICISQAWV CDGVDDCEDN SDEKNC.

5. The binding protein of claim 4, wherein the FGFR1c binding domain of (b) further comprises a linker comprising the sequence SAPASEPPGSL (SEQ ID NO: 12).

6. The binding protein of claim 5, wherein the FGFR1c binding domain comprises one or more of:

(SEQ ID NO: 293)
   CGAGLFTCRSTNICISQVWVCDGVDDCEDNSDEDSCSAPASEPPGSL;

(SEQ ID NO: 294)
   CGAGLFTCRSTNICISQAWVCDGVDDCEDNSDENYCSAPASEPPGSL;

(SEQ ID NO: 295)
   CGAGLFTCRSTNICISQAWVCDGVDDCEDNSDETNCSAPASEPPGSL;

(SEQ ID NO: 448)
   CGEGLFTCGSTNICISSAWVCDGVDDCEDNSDENNCSAPASEPPGSL;

(SEQ ID NO: 297)
   CGEGLFTCRSTNICISHAWVCDGVDDCEDNSDENNCSAPASEPPGSL;

(SEQ ID NO: 449)
   CGEGLFTCRSTNICISEAWICDGVDDCEDNSDEKNCSAPASEPPGSL;

(SEQ ID NO: 450)
   CGAGLFTCRSAKICISHAWVCDGIDDCEDNSDENNCSAPASEPPGSL;

(SEQ ID NO: 464)
   CGAGLFTCRNSKICISQAWVCDGVDDCDDNSDEKYCSAPASEPPGSL;

(SEQ ID NO: 296)
   CGASLFTCRRSNICISQAWVCDGVDDCEDNSDEMNCSAPASEPPGSL;
   and (SEQ ID NO: 287)
   CGAGLFTCRSTKICISQAWVCDGVDDCEDNSDEKNCSAPASEPPGSL.

7. A binding protein that selectively binds β-Klotho and FGFR1c comprising (a) one or more domains that selectively bind β-Klotho, and (b) one or more domains that selectively bind FGFR1c, wherein the binding protein comprises:

(a) a β-Klotho binding domain comprising:
   (i) a first binding domain comprising:

CGADQFRCGNGSCVPRAWRCDGVDDCGDGSDEAPEIC;   (SEQ ID NO: 257)

(ii) a second binding domain comprising one or more of:

CQSNEFRCRSGRCIPQHWLCDGLNDCGDGSDE[PS][PQ][AQ][-H]C;   (SEQ ID NO: 394)

C[ELPQR][APS][DGIN][EGQ][FQ][FKPQRT][-E]C[GNRS][NS]G[HNQR]C[IV]P[AELPQRV][AHPQRT]W[LRV]CDG[DEV][DNP]DC[GLQ]D[DGNS]SDE[AEKT][DGLNS][-A][-H]C;   (SEQ ID NO: 217)
   and C[AGP][APS][DGN][EQ]F[QRT]C[GNRS][GNS][GT][GKQS][-IK]C[ILV]P[LQRV][AEHP]W[LRV]CDG[DLV][DN]DCGD[GN]SDE[AEKPS][GLPS][-AEV][-IT]C,   (SEQ ID NO: 254)

wherein the second binding domain retains the ability to bind β-Klotho;
   and (iii) a linker joining the first binding domain and the second binding domain; and (b) an FGFR1c binding domain comprising a sequence selected from the group represented by the sequence:

CG[AE][GS]LFTC[GR][NRS][AST][KN]ICIS[EHQS][AV]W[IV]CDG[IV]DDC[DE]DNSDE[DKMNT][NSY]C   (SEQ ID NO: 108)

wherein the FGFR1c binding domain retains the ability to bind FGFR1c; and (c) a linker joining the sequences of (a) and (b),
wherein amino acids in brackets indicate alternative amino acids at a specified position and "–" indicates no amino acid at the specified position.

8. The binding protein of claim 7, wherein the second binding domain of (a) comprises one or more of:

CQSNEFRCRSGRCIPQHWLCDGLNDCGDGSDESQQCSAPASEPPGSL   (SEQ ID NO: 481)

CQSNEFRCRSGRCIPQHWLCDGLNDCGDGSDESQQC;   (SEQ ID NO: 159)

CRAGEFRCSNGRCVPLTWLCDGEDDCQDNSDEKNC;   (SEQ ID NO: 1323)

CPSNQFPCRSTGICIPLAWVCDGLNDCGDGSDESPAHC;   (SEQ ID NO: 1324)
and

CQSNEFRCRSGRCIPQHWLCDGLNDCGDGSDEPPAHC.   (SEQ ID NO: 1325)

9. The binding protein of claim 8, wherein the linker of (a) comprises: ETPT (SEQ ID NO: 1319).

10. The binding protein of claim 9, wherein the FGFR1c binding domain comprises one or more of:

CGAGLFTCRS TNICISQVWV CDGVDDCEDN SDEDSC;   (SEQ ID NO: 109)

CGAGLFTCRS TNICISQAWV CDGVDDCEDN SDENYC;   (SEQ ID NO: 110)

CGAGLFTCRS TNICISQAWV CDGVDDCEDN SDETNC;   (SEQ ID NO: 111)

CGEGLFTCGS TNICISSAWV CDGVDDCEDN SDENNC;   (SEQ ID NO: 112)

CGEGLFTCRS TNICISHAWV CDGVDDCEDN SDENNC;   (SEQ ID NO: 113)

CGEGLFTCRS TNICISEAWI CDGVDDCEDN SDEKNC;   (SEQ ID NO: 114)

CGAGLFTCRS AKICISHAWV CDGIDDCEDN SDENNC;   (SEQ ID NO: 115)

CGAGLFTCRN SKICISQAWV CDGVDDCDDN SDEKYC;   (SEQ ID NO: 116)

CGASLFTCRR SNICISQAWV CDGVDDCEDN SDEMNC;   (SEQ ID NO: 117)
and

CGAGLFTCRS TKICISQAWV CDGVDDCEDN SDEKNC.   (SEQ ID NO: 118)

11. The binding protein of claim 10, wherein the FGFR1c binding domain further comprises a linker comprising the sequence

SAPASEPPGSL.   (SEQ ID NO: 12)

12. The binding protein of claim 11, wherein the FGFR1c binding domain comprises one or more of:

CGAGLFTCRSTNICISQVWVCDGVDDCEDNSDEDSCSAPASEPPGSL;   (SEQ ID NO: 293)

CGAGLFTCRSTNICISQAWVCDGVDDCEDNSDENYCSAPASEPPGSL;   (SEQ ID NO: 294)

CGAGLFTCRSTNICISQAWVCDGVDDCEDNSDETNCSAPASEPPGSL;   (SEQ ID NO: 295)

CGEGLFTCGSTNICISSAWVCDGVDDCEDNSDENNCSAPASEPPGSL;   (SEQ ID NO: 448)

CGEGLFTCRSTNICISHAWVCDGVDDCEDNSDENNCSAPASEPPGSL;   (SEQ ID NO: 297)

CGEGLFTCRSTNICISEAWICDGVDDCEDNSDEKNCSAPASEPPGSL;   (SEQ ID NO: 449)

CGAGLFTCRSAKICISHAWVCDGIDDCEDNSDENNCSAPASEPPGSL;   (SEQ ID NO: 450)

CGAGLFTCRNSKICISQAWVCDGVDDCDDNSDEKYCSAPASEPPGSL;   (SEQ ID NO: 464)

CGASLFTCRRSNICISQAWVCDGVDDCEDNSDEMNCSAPASEPPGSL;   (SEQ ID NO: 296)
and

CGAGLFTCRSTKICISQAWVCDGVDDCEDNSDEKNCSAPASEPPGSL.   (SEQ ID NO: 287)

13. The binding protein of claim 12, wherein the FGFR1c binding domain comprises:

```
                                              (SEQ ID NO: 297)
CGEGLFTCRSTNICISHAWVCDGVDDCEDNSDENNCSAPASEPPGSL.
```

14. The binding protein of claim 7, wherein the linker of (c) comprises one or more of: AQPT (SEQ ID NO:1322), AHT, PERT (SEQ ID NO: 7), TTRT (SEQ ID NO: 8), GTTGPT (SEQ ID NO: 9), ETSGPT (SEQ ID NO: 10), SQDPEFH-KVS (SEQ ID NO: 11), SAPASEPPGSL (SEQ ID NO: 12), GRPGPGATSAPAA (SEQ ID NO: 13), and GDSHILPFST-PGPST (SEQ ID NO: 14).

15. A binding protein comprising the sequence:

```
                                              (SEQ ID NO 359)
CGADQFRCGNGSCVPRAWRCDGVDDCGDGSDEAPEICETPTCQSNEFRCRS

GRCIPQHWLCDGLNDCGDGSDESQQCSAPASEPPGSLCGEGLFTCRSTNIC

ISHAWVCDGVDDCEDNSDENNCSAPASEPPGSL.
```

16. The binding protein of claim 1 or 7, wherein the binding protein further comprises a half life-extending moiety that increases the serum half-life of the binding protein in a mammal compared to the serum half-life of the binding protein lacking the half life-extending moiety in a mammal.

17. The binding protein of claim 16, wherein the half life-extending moiety is one or more of: polyethylene glycol (PEG), human serum albumin (HSA), an immunoglobulin (IgG), and an Fc moeity.

18. The binding protein of claim 16, wherein the half life-extending moiety comprises a protein sequence that specifically binds a blood factor.

19. The binding protein of claim 18, wherein the blood factor is serum albumin, an immunoglobulin or an erythrocyte.

20. The binding protein of claim 1 or 7, wherein the binding protein comprises an amino acid sequence comprising one or more non-naturally occurring amino acids.

21. A binding protein that selectively binds β-Klotho and FGFR1c comprising (a) one or more domains that selectively bind β-Klotho, and (b) one or more domains that selectively bind FGFR1c, wherein the binding protein comprises:
   (a) a β-Klotho binding domain comprising one or more of:

```
                                              (SEQ ID NO: 254)
C[AGP][APS][DGN][EQ]F[QRT]C[GNRS][GNS][GT][GKQS]
[IK]C[ILV]P[LQRV][AEHP]W[LRV]CDG[DLV][DN]DCGD
[GN]SDE[AEKPS][GLPS][-AEV][-IT]C;

(SEQ ID NO: 597)
CLPDEFQC[SG]SGRCIPQ[HT]W[VL]CDGLNDCGDGSDE[PS]PA
[HT]C;
                                              (SEQ ID NO: 249)
C[AGPR][AP][DGNS][EQ]F[QRT]C[GSK]N[GT][GHR][-R]
C[ILV][PS][ALQ][NST]W[LRV]CDG[DEV]DDC[GL]DGSDE
[AET][DNS][-A][-T]C,
and
``` wherein the β-Klotho binding domain retains the ability to bind β-Klotho;
   (b) an FGFR1c binding domain comprising:

```
                                              (SEQ ID NO: 297)
CGEGLFTCRSTNICISHAWVCDGVDDCEDNSDENNCSAPASEPPGSL;
``` and
   wherein amino acids in brackets indicate alternative amino acids at a specified position and "–" indicates no amino acid at the specified position.

22. The binding protein of claim 21, further comprising at least one linker joining (a) and (b).

23. The binding protein of claim 22, wherein the linker comprises SAPASEPPGSL (SEQ ID NO:12).

24. The binding protein of claim 23, wherein
   the β-Klotho binding domain of (a) comprises one or more of:

```
                                              (SEQ ID NO: 255)
CGPDQFRCSSGKCIPQHWLCDGLNDCGDGSDESPATC;

(SEQ ID NO: 256)
CGANEFQCRSTGICVPVEWVCDGDNDCGDGSDEPPVC;

(SEQ ID NO: 257)
CGADQFRCGNGSCVPRAWRCDGVDDCGDGSDEAPEIC;

(SEQ ID NO: 258)
CGPDEFRCNNGQCIPLPWRCDGVDDCGDNSDEPLEIC;

(SEQ ID NO: 259)
CASGEFTCNNGQCVPLAWRCDGVNDCQDGSDEKGC;

(SEQ ID NO: 260)
CGPDEFRCNNGQCIPLPWRCDGVDDCGDNSDEPLEIC;

(SEQ ID NO: 261)
CPPDEFQCRGTKKCLPLAWVCDGDNDCEDDSDEESC;

(SEQ ID NO: 1237)
CLPDEFQCGSGRCIPQHWLCDGLNDCGDGSDEPPAHC;

(SEQ ID NO: 1326)
CLPDEFQCGSGRCIPQHWLCDGLNDCGDGSDEPPAHC;

(SEQ ID NO: 1327)
CAPGEFTCKNTGRCIPLNWRCDGDDDCGDGSDETDC;
and (SEQ ID NO: 1328)
CGPDEFRCNNGQCIPLPWRCDGVDDCGDNSDEPLEIC.
```

25. A binding protein that selectively binds β-Klotho and FGFR1c comprising (a) one or more domains that selectively bind β-Klotho, and (b) one or more domains that selectively bind FGFR1c, wherein the binding protein comprises:
   (a) a β-Klotho binding domain comprising:
      (i) a first binding domain comprising one or more of:

```
                                              (SEQ ID NO: 254)
C[AGP][APS][DGN][EQ]F[QRT]C[GNRS][GNS][GT][GKQS]
[-IK]C[ILV]P[LQRV][AEHP]W[LRV]CDG[DLV][DN]DCGD
[GN]SDE[AEKPS][GLPS][-AEV][-IT]C;

(SEQ ID NO: 597)
CLPDEFQC[SG]SGRCIPQ[HT]W[VL]CDGLNDCGDGSDE[PS]PA
[HT]C;
                                              (SEQ ID NO: 249)
C[AGPR][AP][DGNS][EQ]F[QRT]C[GSK]N[GT][GHR][-R]
C[ILV][PS][ALQ][NST]W[LRV]CDG[DEV]DDC[GL]DGSDE
[AET][DNS][-A][-T]C,
``` wherein the first binding domain retains the ability to bind β-Klotho;
      (ii) a second binding domain comprising one or more of:

```
                                              (SEQ ID NO: 394)
CQSNEFRCRSGRCIPQHWLCDGLNDCGDGSDE[PS][PQ][AQ][-H]
C;

(SEQ ID NO: 217)
C[ELPQR][APS][DGIN][EGQ][FQ][FKPQRT][-E]C[GNRS]
[NS]G[HNQR]C[IV]P[AELPQRV][AHPQRT]W[LRV]CDG[DEV]
[DNP]DC[GLQ]D[DGNS]SDE[AEKT][DGLNS][-A][-H]C;
```

-continued

```
                                          (SEQ ID NO: 254)
C[AGP][APS][DGN][EQ]F[QRT]C[GNRS][GNS][GT][GKQS]
[-IK]C[ILV]P[LQRV][AEHP]W[LRV]CDG[DLV][DN]DCGD
[GN]SDE[AEKPS][GLPS][-AEV][-IT]C;

(SEQ ID NO: 481)
CQSNEFRCRSGRCIPQHWLCDGLNDCGDGSDESQQCSAPASEPPGSL,
``` wherein the second binding domain retains the ability to bind β-Klotho; and (iii) a linker joining the first binding domain and the second binding domain; and (b) an FGFR1c binding domain comprising

```
                                          (SEQ ID NO: 297)
CGEGLFTCRSTNICISHAWVCDGVDDCEDNSDENNCSAPASEPPGSL;
``` and (c) a linker joining the sequences of (a) and (b), wherein amino acids in brackets indicate alternative amino acids at a specified position and "–" indicates no amino acid at the specified position.

26. The binding protein of claim 25, wherein the second binding domain of (a) comprises one or more of:

```
                                          (SEQ ID NO: 481)
CQSNEFRCRSGRCIPQHWLCDGLNDCGDGSDESQQCSAPASEPPGSL;

(SEQ ID NO: 159)
CQSNEFRCRSGRCIPQHWLCDGLNDCGDGSDESQQC;

(SEQ ID NO: 1323)
CRAGEFRCSNGRCVPLTWLCDGEDDCQDNSDEKNC;

(SEQ ID NO: 1324)
CPSNQFPCRSTGICIPLAWVCDGLNDCGDGSDESPAHC;
and (SEQ ID NO: 1325)
CQSNEFRCRSGRCIPQHWLCDGLNDCGDGSDEPPAHC.
```

27. The binding protein of claim 26, wherein the linker of (a) comprises ETPT (SEQ IP NO: 1319).

28. The binding protein of claim 27, wherein the first b-Klotho binding domain comprises:

```
                                          (SEQ ID NO: 481)
CQSNEFRCRSGRCIPQHWLCDGLNDCGDGSDESQQCSAPASEPPGSL.
```

29. A pharmaceutical composition comprising: (a) a binding protein of claim 1, 7, 21 or 25, and (b) a pharmaceutically acceptable formulation agent.

30. The pharmaceutical composition of claim 29, wherein the pharmaceutically acceptable formulation agent is a carrier, adjuvant, solubilizer, stabilizer, or anti-oxidant.

31. The binding protein of claim 1, 7, 21 or 25, wherein the β-Klotho binding domain of (a) comprises SEQ ID NO:312.

\* \* \* \* \*